(12) United States Patent
Hansen et al.

(10) Patent No.: US 9,771,566 B2
(45) Date of Patent: Sep. 26, 2017

(54) ORGANOPHOSPHOROUS HYDROLASE VARIANTS

(71) Applicant: Novozymes A/S, Bagsvaerd (DK)

(72) Inventors: Bjarne G. Hansen, Allerod (DK); Lars Kobberoe Skov, Ballerup (DK); Leonardo De Maria, Frederiksberg (DK); Julie Bille Rannes, Copenhagen (DK)

(73) Assignee: Novozymes A/S, Bagsvaerd (DK)

( * ) Notice: Subject to any disclaimer, the term of this patent is extended or adjusted under 35 U.S.C. 154(b) by 0 days.

(21) Appl. No.: 15/036,530

(22) PCT Filed: Nov. 28, 2014

(86) PCT No.: PCT/EP2014/075971
§ 371 (c)(1),
(2) Date: May 13, 2016

(87) PCT Pub. No.: WO2015/079030
PCT Pub. Date: Jun. 4, 2015

(65) Prior Publication Data
US 2016/0289654 A1    Oct. 6, 2016

(30) Foreign Application Priority Data
Nov. 28, 2013 (EP) .................................. 13194860

(51) Int. Cl.
| | |
|---|---|
| *C12N 9/16* | (2006.01) |
| *A62D 3/02* | (2007.01) |
| *C12N 9/18* | (2006.01) |
| *A62D 101/02* | (2007.01) |
| *A62D 101/04* | (2007.01) |
| *A62D 101/26* | (2007.01) |

(52) U.S. Cl.
CPC ................. *C12N 9/16* (2013.01); *A62D 3/02* (2013.01); *C12N 9/18* (2013.01); *C12Y 301/08001* (2013.01); *A62D 2101/02* (2013.01); *A62D 2101/04* (2013.01); *A62D 2101/26* (2013.01)

(58) Field of Classification Search
CPC ..................................... C12N 9/16; C12N 9/18
USPC ......................................................... 435/196
See application file for complete search history.

(56) References Cited

U.S. PATENT DOCUMENTS

| | | |
|---|---|---|
| 6,524,834 B1 | 2/2003 | Ruterjans |
| 2013/0071394 A1 | 3/2013 | Troyer |

FOREIGN PATENT DOCUMENTS

| | | |
|---|---|---|
| WO | 2009/130285 A1 | 10/2009 |
| WO | 2010/128115 A1 | 11/2010 |
| WO | 2010/128116 A1 | 11/2010 |
| WO | 2013/178808 A2 | 12/2013 |

OTHER PUBLICATIONS

Anonymous, NCBI Accession No. XM_005109189 (2013).
Gopal et al., Biochemical and Biophysical Research Communications, vol. 279, No. 2, pp. 516-519 (2000).
Hansen et al., "Protein Engineering of Enzymes for Breakdown of Nerve Agents", 11th CBW Protection Symposium Stockholm (Jul. 2013).
Kolakowski et al., Biocatalysis and Biotransformation, vol. 15, No. 4, pp. 297-312 (1997).

*Primary Examiner* — Tekchand Saidha
(74) *Attorney, Agent, or Firm* — Eric J. Fechter

(57) ABSTRACT

The present invention relates to organophosphorous hydrolase variants. The present invention also relates to polynucleotides encoding the variants; nucleic acid constructs, vectors, and host cells comprising the polynucleotides; and methods of using the variants.

20 Claims, No Drawings

ORGANOPHOSPHOROUS HYDROLASE VARIANTS

CROSS-REFERENCE TO RELATED APPLICATIONS

This application is a 35 U.S.C. 371 national application of PCT/EP2014/075971 filed Nov. 28, 2014, which claims priority or the benefit under 35 U.S.C. 119 of European application no. 13194860.6 filed Nov. 28, 2013. The content of each application is fully incorporated herein by reference.

REFERENCE TO A SEQUENCE LISTING

This application contains a Sequence Listing in computer readable form, which is incorporated herein by reference.

BACKGROUND

Field of the Invention

The present invention relates to organophosphorous hydrolase variants, polynucleotides encoding the variants, methods of producing the variants, and methods of using the variants.

Description of the Related Art

Organophosphorous compounds are known in the art. In particular some warfare agents are known to be organophosphorous compounds such as the G-type nerve agents such as Sarin, Cyclosarin, and Soman and the V-type nerve agents such as VX. Other organophosphorous compounds are known as pesticides.

It is desirable to be able to decontaminate areas contaminated with such organophosphorous compounds. A polypeptide having organophosphorous hydrolase activity, such as diisopropylfluorophosphatase activity has been suggested for this purpose since such polypeptides are capable of hydrolyzing harmful organophosphorous compounds and thereby converting them to less harmful products.

In WO 99/43791, a diisopropylfluorophosphatase from Loligo vulgaris is disclosed and its potential use for decontamination among other applications is also described.

WO 2009/130285, WO 2010/128115 and WO 2010/128116 disclose other diisopropylfluorophosphatases from *Pseudoalteramonas haloplanktis*, *Octopus vulgaris*, and *Aplysia californica*.

The present invention provides organophosphorous hydrolase variants with improved properties compared to its parent.

SUMMARY OF THE INVENTION

The present invention relates to organophosphorous hydrolase variants, comprising a substitution at one or more (e.g., several) positions corresponding to positions P58, R61, F165, M167, R193, P250, and N312 of the mature polypeptide of SEQ ID NO: 2, wherein the variants have organophosphorous hydrolase activity.

The present invention also relates to polynucleotides encoding the variants; nucleic acid constructs, vectors, and host cells comprising the polynucleotides; and methods of producing the variants.

The present invention also relates to methods of decontaminating environments or surfaces exposed to organophosphorous compounds, like nerve gases, toxins, or pesticides.

Definitions

Organophosphorous hydrolase: The term "organophosphorous hydrolase" is defined herein as hydrolytic activity to organophosphorous compounds, in particular phosphorous anhydride bonds in organophosphorous compounds including nerve gases. Thus the term includes an enzyme with hydrolase activity and/or esterase activity, e.g., organophosphorous hydrolase activity (such as an organophosphoesterase activity) or organophosphoric acid anhydrolase (OPAA) activity, or carboxylesterase activity, diisopropylfluorophosphatase (DFPase) activity (EC 3.1.8.2), dehalogenase activity, catalyzing the hydrolyses of phosphorus-sulfur bonds, prolidase activity and/or imidodipeptidase activity.

The term "DFPase (EC3.1.8.2)" is defined herein as diisopropylfluorophosphatase, dialkylfluorophosphatase, diisopropylphosphorofluoridate hydrolase, diisopropylfluorophosphonate dehalogenase, diisopropylphosphofluoridase, isopropylphosphorofluoridase, organophosphate acid anhydrase, organophosphorous acid anhydrolase, somanase, tabunase. DFPases acts on phosphorus anhydride bonds (such as phosphorus-halide and phosphorus-cyanide) in organophosphorous compounds (including nerve gases).

For purposes of the present invention, organophosphorous hydrolase activity is determined according to the procedure described in Example 2. In one aspect, the polypeptides of the present invention have at least 20%, e.g., at least 40%, at least 50%, at least 60%, at least 70%, at least 80%, at least 90%, at least 95%, or at least 100% of the organophosphorous hydrolase activity of the mature polypeptide of SEQ ID NO: 2.

Decontamination: The term "decontamination" is to be understood herein as removing, decomposing or destroying harmful agents such as organophosphorous compounds, e.g. nerve gases, toxins, pesticides, thus the term includes, e.g., detoxification activity.

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

cDNA: The term "cDNA" means a DNA molecule that can be prepared by reverse transcription from a mature, spliced, mRNA molecule obtained from a eukaryotic or prokaryotic cell. cDNA lacks intron sequences that may be present in the corresponding genomic DNA. The initial, primary RNA transcript is a precursor to mRNA that is processed through a series of steps, including splicing, before appearing as mature spliced mRNA.

Coding sequence: The term "coding sequence" means a polynucleotide, which directly specifies the amino acid sequence of a variant. The boundaries of the coding sequence are generally determined by an open reading frame, which begins with a start codon such as ATG, GTG or TTG and ends with a stop codon such as TAA, TAG, or TGA. The coding sequence may be a genomic DNA, cDNA, synthetic DNA, or a combination thereof.

Control sequences: The term "control sequences" means nucleic acid sequences necessary for expression of a polynucleotide encoding a variant of the present invention. Each control sequence may be native (i.e., from the same gene) or foreign (i.e., from a different gene) to the polynucleotide encoding the variant or native or foreign to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a variant.

Expression: The term "expression" includes any step involved in the production of a variant including, but not limited to, transcription, post-transcriptional modification, translation, post-translational modification, and secretion.

Expression vector: The term "expression vector" means a linear or circular DNA molecule that comprises a polynucleotide encoding a variant and is operably linked to control sequences that provide for its expression.

Fragment: The term "fragment" means a polypeptide having one or more (e.g., several) amino acids absent from the amino and/or carboxyl terminus of a mature polypeptide; wherein the fragment has organophosphorous hydrolase activity. In one aspect, a fragment contains at least 290 amino acid residues (e.g., amino acids 24 to 313 of SEQ ID NO: 2), at least 300 amino acid residues (e.g., amino acids 24 to 323 of SEQ ID NO: 2), or at least 308 amino acid residues (e.g., amino acids 24 to 331 of SEQ ID NO: 2).

High stringency conditions: The term "high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 2×SSC, 0.2% SDS at 65° C.

Host cell: The term "host cell" means any cell type that is susceptible to transformation, transfection, transduction, or the like with a nucleic acid construct or expression vector comprising a polynucleotide of the present invention. The term "host cell" encompasses any progeny of a parent cell that is not identical to the parent cell due to mutations that occur during replication.

Improved activity: The term "improved activity" means an organophosphorous hydrolase activity of a variant that is improved compared to the parent, e.g., as described in Examples.

Isolated: The term "isolated" means a substance in a form or environment which does not occur in nature. Non-limiting examples of isolated substances include (1) any non-naturally occurring substance, (2) any substance including, but not limited to, any enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., multiple copies of a gene encoding the substance; use of a stronger promoter than the promoter naturally associated with the gene encoding the substance). An isolated substance may be present in a fermentation broth sample.

Low stringency conditions: The term "low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 2×SSC, 0.2% SDS at 50° C.

Mature polypeptide: The term "mature polypeptide" means a polypeptide in its final form following translation and any post-translational modifications, such as N-terminal processing, C-terminal truncation, glycosylation, phosphorylation, etc. It is known in the art that a host cell may produce a mixture of two of more different mature polypeptides (i.e., with a different C-terminal and/or N-terminal amino acid) expressed by the same polynucleotide.

Mature polypeptide coding sequence: The term "mature polypeptide coding sequence" means a polynucleotide that encodes a mature polypeptide having organophosphorous hydrolase activity.

Medium stringency conditions: The term "medium stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 2×SSC, 0.2% SDS at 55° C.

Medium-high stringency conditions: The term "medium-high stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 2×SSC, 0.2% SDS at 60° C.

Mutant: The term "mutant" means a polynucleotide encoding a variant.

Nucleic acid construct: The term "nucleic acid construct" means a nucleic acid molecule, either single- or double-stranded, which is isolated from a naturally occurring gene or is modified to contain segments of nucleic acids in a manner that would not otherwise exist in nature or which is synthetic, which comprises one or more control sequences.

Operably linked: The term "operably linked" means a configuration in which a control sequence is placed at an appropriate position relative to the coding sequence of a polynucleotide such that the control sequence directs expression of the coding sequence.

Parent or parent organophosphorous hydrolase: The term "parent" or "parent organophosphorous hydrolase" means an organophosphorous hydrolase to which an alteration is made to produce the enzyme variants of the present invention. The parent may be a naturally occurring (wild-type) polypeptide or a variant or fragment thereof.

Sequence identity: The relatedness between two amino acid sequences or between two nucleotide sequences is described by the parameter "sequence identity".

For purposes of the present invention, the sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 5.0.0 or later. The parameters used are gap open penalty of 10, gap extension penalty of 0.5, and the EBLOSUM62 (EMBOSS version of BLOSUM62) substitution matrix. The output of Needle labeled "longest identity" (obtained using the —nobrief option) is used as the percent identity and is calculated as follows:

$$(\text{Identical Residues} \times 100)/(\text{Length of Alignment} - \text{Total Number of Gaps in Alignment})$$

For purposes of the present invention, the sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 5.0.0 or later. The parameters used are gap open penalty of 10, gap extension penalty of 0.5, and the EDNAFULL (EMBOSS version of NCBI NUC4.4) substitution matrix. The output of Needle labeled "longest identity" (obtained using the—nobrief option) is used as the percent identity and is calculated as follows:

(Identical Deoxyribonucleotides×100)/(Length of Alignment−Total Number of Gaps in Alignment)

The sequence identity between the amino acid sequence of SEQ ID NO: 2 and the amino acid sequence of SEQ ID NO: 4 is 99.7%.

Subsequence: The term "subsequence" means a polynucleotide having one or more (e.g., several) nucleotides absent from the 5' and/or 3' end of a mature polypeptide coding sequence; wherein the subsequence encodes a fragment having organophosphorous hydrolase activity. In one aspect, a subsequence contains at least 870 nucleotides (e.g., nucleotides 70 to 937 of SEQ ID NO: 1), at least 900 nucleotides (e.g., nucleotides 70 to 967 of SEQ ID NO: 1), or at least 924 nucleotides (e.g., nucleotides 70 to 993 of SEQ ID NO: 1).

Variant: The term "variant" means a polypeptide having organophosphorous hydrolase activity comprising an alteration, i.e., a substitution, insertion, and/or deletion, at one or more (e.g., several) positions. A substitution means replacement of the amino acid occupying a position with a different amino acid; a deletion means removal of the amino acid occupying a position; and an insertion means adding an amino acid adjacent to and immediately following the amino acid occupying a position. The variants of the present invention have at least 20%, e.g., at least 40%, at least 50%, at least 60%, at least 70%, at least 80%, at least 90%, at least 95%, or at least 100% of the organophosphorous hydrolase activity of the mature polypeptide of SEQ ID NO: 2.

Very high stringency conditions: The term "very high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 2×SSC, 0.2% SDS at 70° C.

Very low stringency conditions: The term "very low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 2×SSC, 0.2% SDS at 45° C.

Wild-type organophosphorous hydrolase: The term "wild-type" organophosphorous hydrolase means an organophosphorous hydrolase expressed by a naturally occurring microorganism, such as a bacterium, yeast, or filamentous fungus found in nature.

Conventions for Designation of Variants

For purposes of the present invention, the mature polypeptide disclosed in SEQ ID NO: 2 is used to determine the corresponding amino acid residue in another organophosphorous hydrolase. The amino acid sequence of another organophosphorous hydrolase is aligned with the mature polypeptide disclosed in SEQ ID NO: 2, and based on the alignment, the amino acid position number corresponding to any amino acid residue in the mature polypeptide disclosed in SEQ ID NO: 2 is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 5.0.0 or later. The parameters used are gap open penalty of 10, gap extension penalty of 0.5, and the EBLOSUM62 (EMBOSS version of BLOSUM62) substitution matrix.

Identification of the corresponding amino acid residue in another organophosphorous hydrolase can be determined by an alignment of multiple polypeptide sequences using several computer programs including, but not limited to, MUSCLE (multiple sequence comparison by log-expectation; version 3.5 or later; Edgar, 2004, *Nucleic Acids Research* 32: 1792-1797), MAFFT (version 6.857 or later; Katoh and Kuma, 2002, *Nucleic Acids Research* 30: 3059-3066; Katoh et al., 2005, *Nucleic Acids Research* 33: 511-518; Katoh and Toh, 2007, *Bioinformatics* 23: 372-374; Katoh et al., 2009, *Methods in Molecular Biology* 537:39-64; Katoh and Toh, 2010, *Bioinformatics* 26:_1899-1900), and EMBOSS EMMA employing ClustalW (1.83 or later; Thompson et al., 1994, *Nucleic Acids Research* 22: 4673-4680), using their respective default parameters.

When the other enzyme has diverged from the mature polypeptide of SEQ ID NO: 2 such that traditional sequence-based comparison fails to detect their relationship (Lindahl and Elofsson, 2000, *J. Mol. Biol.* 295: 613-615), other pairwise sequence comparison algorithms can be used. Greater sensitivity in sequence-based searching can be attained using search programs that utilize probabilistic representations of polypeptide families (profiles) to search databases. For example, the PSI-BLAST program generates profiles through an iterative database search process and is capable of detecting remote homologs (Atschul et al., 1997, *Nucleic Acids Res.* 25: 3389-3402). Even greater sensitivity can be achieved if the family or superfamily for the polypeptide has one or more representatives in the protein structure databases. Programs such as GenTHREADER (Jones, 1999, *J. Mol. Biol.* 287: 797-815; McGuffin and Jones, 2003, *Bioinformatics* 19: 874-881) utilize information from a variety of sources (PSI-BLAST, secondary structure prediction, structural alignment profiles, and solvation potentials) as input to a neural network that predicts the structural fold for a query sequence. Similarly, the method of Gough et al., 2000, *J. Mol. Biol.* 313: 903-919, can be used to align a sequence of unknown structure with the superfamily models present in the SCOP database. These alignments can in turn be used to generate homology models for the polypeptide, and such models can be assessed for accuracy using a variety of tools developed for that purpose.

For proteins of known structure, several tools and resources are available for retrieving and generating structural alignments. For example the SCOP superfamilies of proteins have been structurally aligned, and those alignments are accessible and downloadable. Two or more protein structures can be aligned using a variety of algorithms such as the distance alignment matrix (Holm and Sander, 1998, *Proteins* 33: 88-96) or combinatorial extension (Shindyalov and Bourne, 1998, *Protein Engineering* 11: 739-747), and implementation of these algorithms can additionally be utilized to query structure databases with a structure of interest in order to discover possible structural homologs (e.g., Holm and Park, 2000, *Bioinformatics* 16: 566-567).

In describing the variants of the present invention, the nomenclature described below is adapted for ease of reference. The accepted IUPAC single letter or three letter amino acid abbreviation is employed.

Substitutions.

For an amino acid substitution, the following nomenclature is used: Original amino acid, position, substituted amino acid. Accordingly, the substitution of threonine at position 226 with alanine is designated as "Thr226Ala" or "T226A". Multiple mutations are separated by addition marks ("+"), e.g., "Gly205Arg+Ser411Phe" or "G205R+S411F", representing substitutions at positions 205 and 411 of glycine (G) with arginine (R) and serine (S) with phenylalanine (F), respectively.

Deletions.

For an amino acid deletion, the following nomenclature is used: Original amino acid, position, *. Accordingly, the deletion of glycine at position 195 is designated as "Gly195*" or "G195*". Multiple deletions are separated by addition marks ("+"), e.g., "Gly195*+Ser411*" or "G195*+S411*".

Insertions.

For an amino acid insertion, the following nomenclature is used: Original amino acid, position, original amino acid, inserted amino acid. Accordingly the insertion of lysine after glycine at position 195 is designated "Gly195GlyLys" or "G195GK". An insertion of multiple amino acids is designated [Original amino acid, position, original amino acid, inserted amino acid #1, inserted amino acid #2; etc.]. For example, the insertion of lysine and alanine after glycine at position 195 is indicated as "Gly195GlyLysAla" or "G195GKA".

In such cases the inserted amino acid residue(s) are numbered by the addition of lower case letters to the position number of the amino acid residue preceding the inserted amino acid residue(s). In the above example, the sequence would thus be:

| Parent: | Variant: |
|---|---|
| 195 | 195 195a 195b |
| G | G - K - A |

Multiple Alterations.

Variants comprising multiple alterations are separated by addition marks ("+"), e.g., "Arg170Tyr+Gly195Glu" or "R170Y+G195E" representing a substitution of arginine and glycine at positions 170 and 195 with tyrosine and glutamic acid, respectively.

Different Alterations.

Where different alterations can be introduced at a position, the different alterations are separated by a comma, e.g., "Arg170Tyr,Glu" represents a substitution of arginine at position 170 with tyrosine or glutamic acid. Thus, "Tyr167Gly,Ala+Arg170Gly,Ala" designates the following variants: "Tyr167Gly+Arg170Gly", "Tyr167Gly+Arg170Ala", "Tyr167Ala+Arg170Gly", and "Tyr167Ala+Arg170Ala".

DETAILED DESCRIPTION

Organophosphorous Hydrolase Variants

The sequence identity between the amino acid sequence of SEQ ID NO: 2 and the amino acid sequence of SEQ ID NO: 4 is 99.7%.

The present invention provides organophosphorous hydrolase variants, comprising a substitution at one or more (e.g., several) positions corresponding to positions K34, D37, D38, P58, G59, R61, D63, D91, 194, C96, M111, E164, F165, K166, M167, F169, Q170, E171, R193, F194, T216, R219, D243, E245, Q246, E247, G248, P250, W266, D290, K291, S293, and N312; preferably positions P58, R61, F165, M167, R193, P250, and N312 of the mature polypeptide of SEQ ID NO: 2; wherein the variant has organophosphorous hydrolase activity.

The present invention also provides organophosphorous hydrolase variants, comprising a substitution at one or more (e.g., several) positions corresponding to positions K12, D15, D16, P36, G37, R39, D41, D69, 172, C74, M89, E142, F143, K144, M145, F147, Q148, E149, R171, F172, T194, R197, D221, E223, Q224, E225, G226, P228, W244, D268, K269, S271, and N290; preferably positions P36, R39, F143, M145, R171, P228, and N290 of the mature polypeptide of SEQ ID NO: 4; wherein the variant has organophosphorous hydrolase activity.

In an embodiment, the variant has sequence identity of at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99%, but less than 100%, to the amino acid sequence of the parent organophosphorous hydrolase.

In another embodiment, the variant has at least 60%, e.g., at least 65%, at least 70%, at least 75%, at least 80%, at least 85%, at least 90%, at least 91%, at least 92%, at least 93%, at least 94%, at least 95%, such as at least 96%, at least 97%, at least 98%, or at least 99%, but less than 100%, sequence identity to the mature polypeptide of SEQ ID NO: 2.

In another embodiment, the variant has at least 60%, e.g., at least 65%, at least 70%, at least 75%, at least 80%, at least 85%, at least 90%, at least 91%, at least 92%, at least 93%, at least 94%, at least 95%, such as at least 96%, at least 97%, at least 98%, or at least 99%, but less than 100%, sequence identity to the mature polypeptide of SEQ ID NO: 4.

In one aspect, the number of substitutions in the variants of the present invention is 1-20, e.g., 1-10 and 1-5, such as 1, 2, 3, 4, 5, 6, 7, 8, 9 or 10 substitutions.

In another aspect, a variant comprises a substitution at one or more (e.g., several) positions corresponding to positions P58, R61, F165, M167, R193, P250, and N312 of SEQ ID NO: 2; or positions P36, R39, F143, M145, R171, P228, and N290 of SEQ ID NO: 4. In another aspect, a variant comprises a substitution at two positions corresponding to any of positions P58, R61, F165, M167, R193, P250, and N312 of SEQ ID NO: 2; or positions P36, R39, F143, M145, R171, P228, and N290 of SEQ ID NO: 4. In another aspect, a variant comprises a substitution at three positions corresponding to any of positions P58, R61, F165, M167, R193, P250, and N312 of SEQ ID NO: 2; or positions P36, R39, F143, M145, R171, P228, and N290 of SEQ ID NO: 4. In another aspect, a variant comprises a substitution at four positions corresponding to any of positions P58, R61, F165, M167, R193, P250, and N312 of SEQ ID NO: 2; or positions P36, R39, F143, M145, R171, P228, and N290 of SEQ ID NO: 4. In another aspect, a variant comprises a substitution at five positions corresponding to any of positions P58, R61, F165, M167, R193, P250, and N312 of SEQ ID NO: 2; or positions P36, R39, F143, M145, R171, P228, and N290 of SEQ ID NO: 4. In another aspect, a variant comprises a substitution at six positions corresponding to any of positions P58, R61, F165, M167, R193, P250, and N312 of SEQ ID NO: 2; or positions P36, R39, F143, M145, R171, P228, and N290 of SEQ ID NO: 4. In another aspect, a variant comprises a substitution at each position corresponding to positions P58, R61, F165, M167, R193, P250, and N312 of SEQ ID NO: 2; or positions P36, R39, F143, M145, R171, P228, and N290 of SEQ ID NO: 4.

In another aspect, the variant comprises or consists of a substitution at a position corresponding to position P58. In another aspect, the amino acid at a position corresponding to position P58 is substituted with Ala, Arg, Asn, Asp, Cys, Gln, Glu, Gly, His, Ile, Leu, Lys, Met, Phe, Ser, Thr, Trp, Tyr, or Val, preferably with Ala, Gly, Met, Ser, or Val. In another aspect, the variant comprises or consists of the substitution P58A,G,M,S,V of the mature polypeptide of SEQ ID NO: 2.

In another aspect, the variant comprises or consists of a substitution at a position corresponding to position R61. In another aspect, the amino acid at a position corresponding to position R61 is substituted with Ala, Asn, Asp, Cys, Gln, Glu, Gly, His, Ile, Leu, Lys, Met, Phe, Pro, Ser, Thr, Trp, Tyr, or Val, preferably with Ile, Leu, Asn, Pro, or Val. In another aspect, the variant comprises or consists of the substitution R61I,L,N,P,V of the mature polypeptide of SEQ ID NO: 2.

In another aspect, the variant comprises or consists of a substitution at a position corresponding to position F165. In another aspect, the amino acid at a position corresponding to position F165 is substituted with Ala, Arg, Asn, Asp, Cys, Gln, Glu, Gly, His, Ile, Leu, Lys, Met, Pro, Ser, Thr, Trp, Tyr, or Val, preferably with Ala, Gly, Ile, Leu, Met, Ser, or Val. In another aspect, the variant comprises or consists of the substitution F165A,G,I,L,M,S,V of the mature polypeptide of SEQ ID NO: 2.

In another aspect, the variant comprises or consists of a substitution at a position corresponding to position M167. In another aspect, the amino acid at a position corresponding to position M167 is substituted with Ala, Arg, Asn, Asp, Cys, Gln, Glu, Gly, His, Ile, Leu, Lys, Phe, Pro, Ser, Thr, Trp, Tyr, or Val, preferably with Ala, Gly, Ile, Ser, or Val. In another aspect, the variant comprises or consists of the substitution M167A,G,I,S,V of the mature polypeptide of SEQ ID NO: 2.

In another aspect, the variant comprises or consists of a substitution at a position corresponding to position R193. In another aspect, the amino acid at a position corresponding to position R193 is substituted with Ala, Asn, Asp, Cys, Gln, Glu, Gly, His, Ile, Leu, Lys, Met, Phe, Pro, Ser, Thr, Trp, Tyr, or Val, preferably with Asn or Gln. In another aspect, the variant comprises or consists of the substitution R193N,Q of the mature polypeptide of SEQ ID NO: 2.

In another aspect, the variant comprises or consists of a substitution at a position corresponding to position P250. In another aspect, the amino acid at a position corresponding to position P250 is substituted with Ala, Arg, Asn, Asp, Cys, Gln, Glu, Gly, His, Ile, Leu, Lys, Met, Phe, Ser, Thr, Trp, Tyr, or Val, preferably with Ala, Gly, Ile, or Met. In another aspect, the variant comprises or consists of the substitution P250A,G,I,M of the mature polypeptide of SEQ ID NO: 2.

In another aspect, the variant comprises or consists of a substitution at a position corresponding to position N312. In another aspect, the amino acid at a position corresponding to position N312 is substituted with Ala, Arg, Asp, Cys, Gln, Glu, Gly, His, Ile, Leu, Lys, Met, Phe, Pro, Ser, Thr, Trp, Tyr, or Val, preferably with Asp. In another aspect, the variant comprises or consists of the substitution N312D of the mature polypeptide of SEQ ID NO: 2.

In another aspect, the variant comprises or consists of a substitution at a position corresponding to position P36. In another aspect, the amino acid at a position corresponding to position P36 is substituted with Ala, Arg, Asn, Asp, Cys, Gln, Glu, Gly, His, Ile, Leu, Lys, Met, Phe, Ser, Thr, Trp, Tyr, or Val, preferably with Ala, Gly, Met, Ser, or Val. In another aspect, the variant comprises or consists of the substitution P36A,G,M,S,V of the mature polypeptide of SEQ ID NO: 4.

In another aspect, the variant comprises or consists of a substitution at a position corresponding to position R39. In another aspect, the amino acid at a position corresponding to position R39 is substituted with Ala, Asn, Asp, Cys, Gln, Glu, Gly, His, Ile, Leu, Lys, Met, Phe, Pro, Ser, Thr, Trp, Tyr, or Val, preferably with Ile, Leu, Asn, Pro, or Val. In another aspect, the variant comprises or consists of the substitution R39I,L,N,P,V of the mature polypeptide of SEQ ID NO: 4.

In another aspect, the variant comprises or consists of a substitution at a position corresponding to position F143. In another aspect, the amino acid at a position corresponding to position F143 is substituted with Ala, Arg, Asn, Asp, Cys, Gln, Glu, Gly, His, Ile, Leu, Lys, Met, Pro, Ser, Thr, Trp, Tyr, or Val, preferably with Ala, Gly, Ile, Leu, Met, Ser, or Val. In another aspect, the variant comprises or consists of the substitution F143A,G,I,L,M,S,V of the mature polypeptide of SEQ ID NO: 4.

In another aspect, the variant comprises or consists of a substitution at a position corresponding to position M145. In another aspect, the amino acid at a position corresponding to position M145 is substituted with Ala, Arg, Asn, Asp, Cys, Gln, Glu, Gly, His, Ile, Leu, Lys, Phe, Pro, Ser, Thr, Trp, Tyr, or Val, preferably with Ala, Gly, Ile, Ser, or Val. In another aspect, the variant comprises or consists of the substitution M145A,G,I,S,V of the mature polypeptide of SEQ ID NO: 4.

In another aspect, the variant comprises or consists of a substitution at a position corresponding to position R171. In another aspect, the amino acid at a position corresponding to position R171 is substituted with Ala, Asn, Asp, Cys, Gln, Glu, Gly, His, Ile, Leu, Lys, Met, Phe, Pro, Ser, Thr, Trp, Tyr, or Val, preferably with Asn or Gln. In another aspect, the variant comprises or consists of the substitution R171N,Q of the mature polypeptide of SEQ ID NO: 4.

In another aspect, the variant comprises or consists of a substitution at a position corresponding to position P228. In another aspect, the amino acid at a position corresponding to position P228 is substituted with Ala, Arg, Asn, Asp, Cys, Gln, Glu, Gly, His, Ile, Leu, Lys, Met, Phe, Ser, Thr, Trp, Tyr, or Val, preferably with [Gly]. In another aspect, the variant comprises or consists of the substitution P228A,G,I,M of the mature polypeptide of SEQ ID NO: 4.

In another aspect, the variant comprises or consists of a substitution at a position corresponding to position N290. In another aspect, the amino acid at a position corresponding to position N290 is substituted with Ala, Arg, Asp, Cys, Gln, Glu, Gly, His, Ile, Leu, Lys, Met, Phe, Pro, Ser, Thr, Trp, Tyr, or Val, preferably with Asp. In another aspect, the variant comprises or consists of the substitution N290D of the mature polypeptide of SEQ ID NO: 4.

In another aspect, the variant comprises or consists of substitutions at positions corresponding to positions P58 and R61, such as those described above.

In another aspect, the variant comprises or consists of substitutions at positions corresponding to positions P58 and F165, such as those described above.

In another aspect, the variant comprises or consists of substitutions at positions corresponding to positions P58 and M167, such as those described above.

In another aspect, the variant comprises or consists of substitutions at positions corresponding to positions P58 and R193, such as those described above.

In another aspect, the variant comprises or consists of substitutions at positions corresponding to positions P58 and P250, such as those described above.

In another aspect, the variant comprises or consists of substitutions at positions corresponding to positions P58 and N312, such as those described above.

In another aspect, the variant comprises or consists of substitutions at positions corresponding to positions R61 and F165, such as those described above.

In another aspect, the variant comprises or consists of substitutions at positions corresponding to positions R61 and M167, such as those described above.

In another aspect, the variant comprises or consists of substitutions at positions corresponding to positions R61 and R193, such as those described above.

In another aspect, the variant comprises or consists of substitutions at positions corresponding to positions R61 and P250, such as those described above.

In another aspect, the variant comprises or consists of substitutions at positions corresponding to positions R61 and N312, such as those described above.

In another aspect, the variant comprises or consists of substitutions at positions corresponding to positions F165 and M167, such as those described above.

In another aspect, the variant comprises or consists of substitutions at positions corresponding to positions F165 and R193, such as those described above.

In another aspect, the variant comprises or consists of substitutions at positions corresponding to positions F165 and P250, such as those described above.

In another aspect, the variant comprises or consists of substitutions at positions corresponding to positions F165 and N312, such as those described above.

In another aspect, the variant comprises or consists of substitutions at positions corresponding to positions M167 and R193, such as those described above.

In another aspect, the variant comprises or consists of substitutions at positions corresponding to positions M167 and P250, such as those described above.

In another aspect, the variant comprises or consists of substitutions at positions corresponding to positions M167 and N312, such as those described above.

In another aspect, the variant comprises or consists of substitutions at positions corresponding to positions R193 and P250, such as those described above.

In another aspect, the variant comprises or consists of substitutions at positions corresponding to positions R193 and N312, such as those described above.

In another aspect, the variant comprises or consists of substitutions at positions corresponding to positions P250 and N312, such as those described above.

In another aspect, the variant comprises or consists of substitutions at positions corresponding to positions P58, R61, and F165, such as those described above.

In another aspect, the variant comprises or consists of substitutions at positions corresponding to positions P58, R61, and M167, such as those described above.

In another aspect, the variant comprises or consists of substitutions at positions corresponding to positions P58, R61, and R193, such as those described above.

In another aspect, the variant comprises or consists of substitutions at positions corresponding to positions P58, R61, and P250, such as those described above.

In another aspect, the variant comprises or consists of substitutions at positions corresponding to positions P58, R61, and N312, such as those described above.

In another aspect, the variant comprises or consists of substitutions at positions corresponding to positions P58, F165, and M167, such as those described above.

In another aspect, the variant comprises or consists of substitutions at positions corresponding to positions P58, F165, and R193, such as those described above.

In another aspect, the variant comprises or consists of substitutions at positions corresponding to positions P58, F165, and P250, such as those described above.

In another aspect, the variant comprises or consists of substitutions at positions corresponding to positions P58, F165, and N312, such as those described above.

In another aspect, the variant comprises or consists of substitutions at positions corresponding to positions P58, M167, and R193, such as those described above.

In another aspect, the variant comprises or consists of substitutions at positions corresponding to positions P58, M167, and P250, such as those described above.

In another aspect, the variant comprises or consists of substitutions at positions corresponding to positions P58, M167, and N312, such as those described above.

In another aspect, the variant comprises or consists of substitutions at positions corresponding to positions P58, R193, and P250, such as those described above.

In another aspect, the variant comprises or consists of substitutions at positions corresponding to positions P58, R193, and N312, such as those described above.

In another aspect, the variant comprises or consists of substitutions at positions corresponding to positions P58, P250, and N312, such as those described above.

In another aspect, the variant comprises or consists of substitutions at positions corresponding to positions R61, F165, and M167, such as those described above.

In another aspect, the variant comprises or consists of substitutions at positions corresponding to positions R61, F165, and R193, such as those described above.

In another aspect, the variant comprises or consists of substitutions at positions corresponding to positions R61, F165, and P250, such as those described above.

In another aspect, the variant comprises or consists of substitutions at positions corresponding to positions R61, F165, and N312, such as those described above.

In another aspect, the variant comprises or consists of substitutions at positions corresponding to positions R61, M167, and R193, such as those described above.

In another aspect, the variant comprises or consists of substitutions at positions corresponding to positions R61, M167, and P250, such as those described above.

In another aspect, the variant comprises or consists of substitutions at positions corresponding to positions R61, M167, and N312, such as those described above.

In another aspect, the variant comprises or consists of substitutions at positions corresponding to positions R61, R193, and P250, such as those described above.

In another aspect, the variant comprises or consists of substitutions at positions corresponding to positions R61, R193, and N312, such as those described above.

In another aspect, the variant comprises or consists of substitutions at positions corresponding to positions R61, P250, and N312, such as those described above.

In another aspect, the variant comprises or consists of substitutions at positions corresponding to positions F165, M167, and R193, such as those described above.

In another aspect, the variant comprises or consists of substitutions at positions corresponding to positions F165, M167, and P250, such as those described above.

In another aspect, the variant comprises or consists of substitutions at positions corresponding to positions F165, M167, and N312, such as those described above.

In another aspect, the variant comprises or consists of substitutions at positions corresponding to positions F165, R193, and P250, such as those described above.

In another aspect, the variant comprises or consists of substitutions at positions corresponding to positions F165, R193, and N312, such as those described above.

In another aspect, the variant comprises or consists of substitutions at positions corresponding to positions F165, P250, and N312, such as those described above.

In another aspect, the variant comprises or consists of substitutions at positions corresponding to positions M167, R193, and P250, such as those described above.

In another aspect, the variant comprises or consists of substitutions at positions corresponding to positions M167, R193, and N312, such as those described above.

In another aspect, the variant comprises or consists of substitutions at positions corresponding to positions M167, P250, and N312, such as those described above.

In another aspect, the variant comprises or consists of substitutions at positions corresponding to positions R193, P250, and N312, such as those described above.

In another aspect, the variant comprises or consists of substitutions at positions corresponding to positions P58, R61, F165, and M167, such as those described above.

In another aspect, the variant comprises or consists of substitutions at positions corresponding to positions P58, R61, F165, and R193, such as those described above.

In another aspect, the variant comprises or consists of substitutions at positions corresponding to positions P58, R61, F165, and P250, such as those described above.

In another aspect, the variant comprises or consists of substitutions at positions corresponding to positions P58, R61, F165, and N312, such as those described above.

In another aspect, the variant comprises or consists of substitutions at positions corresponding to positions P58, R61, M167, and R193, such as those described above.

In another aspect, the variant comprises or consists of substitutions at positions corresponding to positions P58, R61, M167, and P250, such as those described above.

In another aspect, the variant comprises or consists of substitutions at positions corresponding to positions P58, R61, M167, and N312, such as those described above.

In another aspect, the variant comprises or consists of substitutions at positions corresponding to positions P58, R61, R193, and P250, such as those described above.

In another aspect, the variant comprises or consists of substitutions at positions corresponding to positions P58, R61, R193, and N312, such as those described above.

In another aspect, the variant comprises or consists of substitutions at positions corresponding to positions P58, R61, P250, and N312, such as those described above.

In another aspect, the variant comprises or consists of substitutions at positions corresponding to positions P58, F165, M167, and R193, such as those described above.

In another aspect, the variant comprises or consists of substitutions at positions corresponding to positions P58, F165, M167, and P250, such as those described above.

In another aspect, the variant comprises or consists of substitutions at positions corresponding to positions P58, F165, M167, and N312, such as those described above.

In another aspect, the variant comprises or consists of substitutions at positions corresponding to positions P58, F165, R193, and P250, such as those described above.

In another aspect, the variant comprises or consists of substitutions at positions corresponding to positions P58, F165, R193, and N312, such as those described above.

In another aspect, the variant comprises or consists of substitutions at positions corresponding to positions P58, F165, P250, and N312, such as those described above.

In another aspect, the variant comprises or consists of substitutions at positions corresponding to positions P58, M167, R193, and P250, such as those described above.

In another aspect, the variant comprises or consists of substitutions at positions corresponding to positions P58, M167, R193, and N312, such as those described above.

In another aspect, the variant comprises or consists of substitutions at positions corresponding to positions P58, M167, P250, and N312, such as those described above.

In another aspect, the variant comprises or consists of substitutions at positions corresponding to positions P58, R193, P250, and N312, such as those described above.

In another aspect, the variant comprises or consists of substitutions at positions corresponding to positions R61, F165, M167, and R193, such as those described above.

In another aspect, the variant comprises or consists of substitutions at positions corresponding to positions R61, F165, M167, and P250, such as those described above.

In another aspect, the variant comprises or consists of substitutions at positions corresponding to positions R61, F165, M167, and N312, such as those described above.

In another aspect, the variant comprises or consists of substitutions at positions corresponding to positions R61, F165, R193, and P250, such as those described above.

In another aspect, the variant comprises or consists of substitutions at positions corresponding to positions R61, F165, R193, and N312, such as those described above.

In another aspect, the variant comprises or consists of substitutions at positions corresponding to positions R61, F165, P250, and N312, such as those described above.

In another aspect, the variant comprises or consists of substitutions at positions corresponding to positions R61, M167, R193, and P250, such as those described above.

In another aspect, the variant comprises or consists of substitutions at positions corresponding to positions R61, M167, R193, and N312, such as those described above.

In another aspect, the variant comprises or consists of substitutions at positions corresponding to positions R61, M167, P250, and N312, such as those described above.

In another aspect, the variant comprises or consists of substitutions at positions corresponding to positions R61, R193, P250, and N312, such as those described above.

In another aspect, the variant comprises or consists of substitutions at positions corresponding to positions F165, M167, R193, and P250, such as those described above.

In another aspect, the variant comprises or consists of substitutions at positions corresponding to positions F165, M167, R193, and N312, such as those described above.

In another aspect, the variant comprises or consists of substitutions at positions corresponding to positions F165, M167, P250, and N312, such as those described above.

In another aspect, the variant comprises or consists of substitutions at positions corresponding to positions F165, R193, P250, and N312, such as those described above.

In another aspect, the variant comprises or consists of substitutions at positions corresponding to positions M167, R193, P250, and N312, such as those described above.

In another aspect, the variant comprises or consists of substitutions at positions corresponding to positions P58, R61, F165, M167, and R193, such as those described above.

In another aspect, the variant comprises or consists of substitutions at positions corresponding to positions P58, R61, F165, M167, and P250, such as those described above.

In another aspect, the variant comprises or consists of substitutions at positions corresponding to positions P58, R61, F165, M167, and N312, such as those described above.

In another aspect, the variant comprises or consists of substitutions at positions corresponding to positions P58, R61, F165, R193, and P250, such as those described above.

In another aspect, the variant comprises or consists of substitutions at positions corresponding to positions P58, R61, F165, R193, and N312, such as those described above.

In another aspect, the variant comprises or consists of substitutions at positions corresponding to positions P58, R61, F165, P250, and N312, such as those described above.

In another aspect, the variant comprises or consists of substitutions at positions corresponding to positions P58, R61, M167, R193, and P250, such as those described above.

In another aspect, the variant comprises or consists of substitutions at positions corresponding to positions P58, R61, M167, R193, and N312, such as those described above.

In another aspect, the variant comprises or consists of substitutions at positions corresponding to positions P58, R61, M167, P250, and N312, such as those described above.

In another aspect, the variant comprises or consists of substitutions at positions corresponding to positions P58, R61, R193, P250, and N312, such as those described above.

In another aspect, the variant comprises or consists of substitutions at positions corresponding to positions P58, F165, M167, R193, and P250, such as those described above.

In another aspect, the variant comprises or consists of substitutions at positions corresponding to positions P58, F165, M167, R193, and N312, such as those described above.

In another aspect, the variant comprises or consists of substitutions at positions corresponding to positions P58, F165, M167, P250, and N312, such as those described above.

In another aspect, the variant comprises or consists of substitutions at positions corresponding to positions P58, F165, R193, P250, and N312, such as those described above.

In another aspect, the variant comprises or consists of substitutions at positions corresponding to positions P58, M167, R193, P250, and N312, such as those described above.

In another aspect, the variant comprises or consists of substitutions at positions corresponding to positions R61, F165, M167, R193, and P250, such as those described above.

In another aspect, the variant comprises or consists of substitutions at positions corresponding to positions R61, F165, M167, R193, and N312, such as those described above.

In another aspect, the variant comprises or consists of substitutions at positions corresponding to positions R61, F165, M167, P250, and N312, such as those described above.

In another aspect, the variant comprises or consists of substitutions at positions corresponding to positions R61, F165, R193, P250, and N312, such as those described above.

In another aspect, the variant comprises or consists of substitutions at positions corresponding to positions R61, M167, R193, P250, and N312, such as those described above.

In another aspect, the variant comprises or consists of substitutions at positions corresponding to positions F165, M167, R193, P250, and N312, such as those described above.

In another aspect, the variant comprises or consists of substitutions at positions corresponding to positions P58, R61, F165, M167, R193, and P250, such as those described above.

In another aspect, the variant comprises or consists of substitutions at positions corresponding to positions P58, R61, F165, M167, R193, and N312, such as those described above.

In another aspect, the variant comprises or consists of substitutions at positions corresponding to positions P58, R61, F165, M167, P250, and N312, such as those described above.

In another aspect, the variant comprises or consists of substitutions at positions corresponding to positions P58, R61, F165, R193, P250, and N312, such as those described above.

In another aspect, the variant comprises or consists of substitutions at positions corresponding to positions P58, R61, M167, R193, P250, and N312, such as those described above.

In another aspect, the variant comprises or consists of substitutions at positions corresponding to positions P58, F165, M167, R193, P250, and N312, such as those described above.

In another aspect, the variant comprises or consists of substitutions at positions corresponding to positions R61, F165, M167, R193, P250, and N312, such as those described above.

In another aspect, the variant comprises or consists of substitutions at positions corresponding to positions P58, R61, F165, M167, R193, P250, and N312, such as those described above.

In another aspect, the variant comprises or consists of one or more (e.g., several) substitutions selected from the group consisting of P58A,G,M,S,V; R61I,L,N,P,V; F165A,G,I,L, M,S,V; M167A,G,I,S,V; R193N,Q; P250A,G,I,M; and N312D.

The variants may further comprise one or more additional substitutions at one or more (e.g., several) other positions selected from the group consisting of K34, D37, D38, G59, D63, D91, I94, C96, M111, E164, K166, F169, Q170, E171, F194, T216, R219, D243, E245, Q246, E247, G248, W266, D290, K291, and S293 of SEQ ID NO: 2.

Preferably the additional substitutions are selected from the group consisting of K34A; D37A,N,S,T; D38A,E,N; G59A,P,S,T; D63E,N,R; D91N,S,T; I94A,F,G,V; C96A,G; M111A,G; E164A,P; K166S,T; F169I,L,V,W,Y; Q170D,E, N; E171A,Q; F194A,W; T216A,M,V; R219A,K,S,T; D243A,G,N,Q; E245D,Q; Q246A,S,T; E247A,D,Q,W; G248A,V; W266F; D290A,E,N,Q; K291A,T; and S293T of SEQ ID NO: 2.

In another aspect, the variant comprises or consists of the substitutions F169I, W266F, C96A, E171Q, Q246S, R193Q, K291T, F169Y, F169W, T216A, G248V, P58G, M111A, G248A, I94V, I94A, C96G, I94G, G59P, G59T, F194A, P58V, F165G, M167I, G59S, M111G, P250G, P58M, T216M, F165L, P250A, E247W, F165M, N312D, P58S, T216V, M167V, P58A, F194W, M167S, R61L, R61P, R61N, I94F, R61I, F165I, R61V, F165A, F165V, F165S, M167G, M167A, D38A+M167A, P250I+M167A, E247A+M167A, P250M+M167A, D91N+M167A, R219S+M167A, D37N+M167A, K34A+M167A, E164P+M167A, R219A+M167A, R61L+M167A, F165A+M167A, D91S+M167A, D37T+M167A, R219T+M167A, K166S+M167A, Q170E+M167A, D37S+M167A, K166T+M167A, D63N+M167A, F165S+M167A, D91T+M167A, K291A+M167A, Q246A+M167A, E247Q+M167A, D37A+M167A, Q246T+M167A, D38E+M167A, D38N+M167A, E247D+M167A, E171Q+M167A, K291T+M167A, D243A+M167A, D290N+M167A, D290Q+M167A, Q246S+M167A, R219K+M167A, D63R+M167A, D290A+M167A, D63E+M167A, R193N+M167A, E245D+M167A, D290E+M167A, E164A+M167A, D243Q+M167A, D243G+M167A, D243N+M167A, E245Q+M167A, Q170D+M167A, E171A+M167A, Q170N+M167A, P250A+M167A, P250G+M167A, R193Q+M167A, N312D+M167A, R61V+M167A+P250G, W266F+M167A+P250G, R61L+N312D+M167A, I94F+M167A+P250G, N312D+M167A+P250G, R61N+M167A+P250G, R193Q+M167A+P250G, E171Q+M167A+P250G, F165V+M167A+P250G, R61P+M167A+P250G, Q246S+M167A+P250G, E245D+M167A+P250G, K291T+M167A+P250G, R61L+M167A+P250G, R61I+M167A+P250G, E245D+M167A+P250G+R61L, F169V+M167A+P250G+R61L, F165S+M167A+P250G+R61L, G59P+M167A+P250G+R61L, N312D+M167A+P250G+R61L, G59A+M167A+P250G+R61L, I94V+M167A+P250G+R61L, F165M+M167A+P250G+R61L,I94A+M167A+P250G+R61L, C96G+M167A+P250G+R61L, F169I+M167A+P250G+R61L, P58M+M167A+P250G+R61L, T216A+M167A+P250G+R61L, K291T+M167A+P250G+R61L, G59S+M167A+P250G+R61L, S293T+M167A+P250G+R61L, F169L+M167A+P250G+R61L, P58V+M167A+P250G+R61L, P58A+M167A+P250G+R61L, or C96A+M167A+P250G+R61L of the mature polypeptide of SEQ ID NO: 2, or of a polypeptide having at least 65%, at least 70%, at least 75%, at least 80%, at least 85%, at least 90%, at least 91%, at least 92%, at least 93%, at least 94%, at least 95%, at least 96%, at least 97%, at least 98%, at least 99% identity to the mature polypeptide of SEQ ID NO: 2 which has organophosphorous hydrolase activity, and further the variant has improved organophosphorous hydrolase activity compared to the mature organophosphorous hydrolase of SEQ ID NO: 2.

In another aspect, the variant comprises or consists of the substitutions F1471, W244F, C74A, E149Q, Q224S, R171Q, K269T, F147Y, F147W, TI94A, G226V, P36G, M89A, G226A, 172V, 172A, C74G, 172G, G37P, G37T, F172A, P36V, F143G, M1451, G37S, M89G, P228G, P36M, T194M, F143L, P228A, E225W, F143M, N290D, P36S, T194V, M145V, P36A, F172W, M145S, R39L, R39P, R39N, 172F, R391, F1431, R39V, F143A, F143V, F143S, M145G, M145A, D16A+M145A, P2281+M145A, E225A+M145A, P228M+M145A, D69N+M145A, R197S+M145A, D15N+M145A, K12A+M145A, E142P+M145A, R197A+M145A, R39L+M145A, F143A+M145A, D69S+M145A, D15T+M145A, R197T+M145A, K144S+M145A, Q148E+M145A, D15S+M145A, K144T+M145A, D41N+M145A, F143S+M145A, D69T+M145A, K269A+M145A, Q224A+M145A, E225Q+M145A, D15A+M145A, Q224T+M145A, D16E+M145A, D16N+M145A, E225D+M145A, E149Q+M145A, K269T+M145A, D221A+M145A, D268N+M145A, D268Q+M145A, Q224S+M145A, R197K+M145A, D41R+M145A, D268A+M145A, D41E+M145A, R171N+M145A, E223D+M145A, D268E+M145A, E142A+M145A, D221Q+M145A, D221G+M145A, D221N+M145A, E223Q+M145A, Q148D+M145A, E149A+M145A, Q148N+M145A, P228A+M145A, P228G+M145A, R171Q+M145A, N290D+M145A, R39V+M145A+P228G, W244F+M145A+P228G, R39L+N290D+M145A, 172F+M145A+P228G, N290D+M145A+P228G, R39N+M145A+P228G, R171Q+M145A+P228G, E149Q+M145A+P228G, F143V+M145A+P228G, R39P+M145A+P228G, Q224S+M145A+P228G, E223D+M145A+P228G, K269T+M145A+P228G, R39L+M145A+P228G, R391+M145A+P228G, E223D+M145A+P228G+R39L, F147V+M145A+P228G+R39L, F143S+M145A+P228G+R39L, G37P+M145A+P228G+R39L, N290D+M145A+P228G+R39L, G37A+M145A+P228G+R39L, 172V+M145A+P228G+R39L, F143M+M145A+P228G+R39L, 172A+M145A+P228G+R39L, C74G+M145A+P228G+R39L, F1471+M145A+P228G+R39L, P36M+M145A+P228G+R39L, TI94A+M145A+P228G+R39L, K269T+M145A+P228G+R39L, G37S+M145A+P228G+R39L, S271T+M145A+P228G+R39L, F147L+M145A+P228G+R39L, P36V+M145A+P228G+R39L, P36A+M145A+P228G+R39L, or C74A+M145A+P228G+R39L of the mature polypeptide of SEQ ID NO: 4, or of a polypeptide having at least 65%, at least 70%, at least 75%, at least 80%, at least 85%, at least 90%, at least 91%, at least 92%, at least 93%, at least 94%, at least 95%, at least 96%, at least 97%, at least 98%, at least 99% identity to the mature polypeptide of SEQ ID NO: 4 which has organophosphorous hydrolase activity, and further the variant has improved organophosphorous hydrolase activity compared to the mature organophosphorous hydrolase of SEQ ID NO: 4.

The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a poly-histidine tract, an antigenic epitope or a binding domain.

Examples of conservative substitutions are within the groups of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, *The Proteins*, Academic Press, New York. Common substitutions are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Alternatively, the amino acid changes are of such a nature that the physico-chemical properties of the polypeptides are altered. For example, amino acid changes may improve the thermal stability of the polypeptide, alter the substrate specificity, change the pH optimum, and the like.

Essential amino acids in a polypeptide can be identified according to procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant mutant molecules are tested for organophosphorous hydrolase activity to identify amino acid residues that are critical to the activity of the molecule. See also, Hilton et al., 1996, *J. Biol. Chem.* 271: 4699-4708. The active site of the enzyme or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identity of essential amino acids can also be inferred from an alignment with a related polypeptide.

The variants may consist of 290 to 308 amino acids, e.g., 300 to 308 amino acids.

In an embodiment, the variant has improved organophosphorous hydrolase activity (catalytic rate) compared to the parent enzyme.

Parent Organophosphorous Hydrolases

The parent organophosphorous hydrolase may be (a) a polypeptide having at least 60% sequence identity to the mature polypeptide of SEQ ID NO: 2; (b) a polypeptide encoded by a polynucleotide that hybridizes under low stringency conditions with (i) the mature polypeptide coding sequence of SEQ ID NO: 1, or (ii) the full-length complement of (i); or (c) a polypeptide encoded by a polynucleotide having at least 60% sequence identity to the mature polypeptide coding sequence of SEQ ID NO: 1.

In an aspect, the parent has a sequence identity to the mature polypeptide of SEQ ID NO: 2 of at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100%, which have organophosphorous hydrolase activity. In one aspect, the amino acid sequence of the parent differs by up to 10 amino acids, e.g., 1, 2, 3, 4, 5, 6, 7, 8, 9, or 10, from the mature polypeptide of SEQ ID NO: 2.

In another aspect, the parent comprises or consists of the amino acid sequence of SEQ ID NO: 2. In another aspect, the parent comprises or consists of the mature polypeptide of SEQ ID NO: 2.

In another aspect, the parent is a fragment of the mature polypeptide of SEQ ID NO: 2 containing at least 308 amino acid residues, e.g., at least 300 and at least 290 amino acid residues.

In another embodiment, the parent is an allelic variant of the mature polypeptide of SEQ ID NO: 2.

The parent organophosphorous hydrolase may also be (a) a polypeptide having at least 60% sequence identity to the mature polypeptide of SEQ ID NO: 4; (b) a polypeptide encoded by a polynucleotide that hybridizes under low stringency conditions with (i) the mature polypeptide coding sequence of SEQ ID NO: 3, or (ii) the full-length complement of (i); or (c) a polypeptide encoded by a polynucleotide having at least 60% sequence identity to the mature polypeptide coding sequence of SEQ ID NO: 3.

In an aspect, the parent has a sequence identity to the mature polypeptide of SEQ ID NO: 4 of at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100%, which have organophosphorous hydrolase activity. In one aspect, the amino acid sequence of the parent differs by up to 10 amino acids, e.g., 1, 2, 3, 4, 5, 6, 7, 8, 9, or 10, from the mature polypeptide of SEQ ID NO: 4.

In another aspect, the parent comprises or consists of the amino acid sequence of SEQ ID NO: 4. In another aspect, the parent comprises or consists of the mature polypeptide of SEQ ID NO: 4.

In another aspect, the parent is a fragment of the mature polypeptide of SEQ ID NO: 4 containing at least 300 amino acid residues, e.g., at least 290 amino acid residues.

In another embodiment, the parent is an allelic variant of the mature polypeptide of SEQ ID NO: 4.

In another aspect, the parent is encoded by a polynucleotide that hybridizes under very low stringency conditions, low stringency conditions, medium stringency conditions, medium-high stringency conditions, high stringency conditions, or very high stringency conditions with (i) the mature polypeptide coding sequence of SEQ ID NO: 1, or (ii) the full-length complement of (i) (Sambrook et al., 1989, *Molecular Cloning, A Laboratory Manual*, 2d edition, Cold Spring Harbor, N.Y.).

The polynucleotide of SEQ ID NO: 1 or a subsequence thereof, as well as the polypeptide of SEQ ID NO: 2 or a fragment thereof, may be used to design nucleic acid probes to identify and clone DNA encoding a parent from strains of different genera or species according to methods well known in the art. In particular, such probes can be used for hybridization with the genomic DNA or cDNA of a cell of interest, following standard Southern blotting procedures, in order to identify and isolate the corresponding gene therein. Such probes can be considerably shorter than the entire sequence, but should be at least 15, e.g., at least 25, at least 35, or at least 70 nucleotides in length. Preferably, the nucleic acid probe is at least 100 nucleotides in length, e.g., at least 200 nucleotides, at least 300 nucleotides, at least 400 nucleotides, at least 500 nucleotides, at least 600 nucleotides, at least 700 nucleotides, at least 800 nucleotides, or at least 900 nucleotides in length. Both DNA and RNA probes can be used. The probes are typically labeled for detecting the corresponding gene (for example, with $^{32}P$, $^{3}H$, $^{35}S$, biotin, or avidin). Such probes are encompassed by the present invention.

A genomic DNA or cDNA library prepared from such other strains may be screened for DNA that hybridizes with the probes described above and encodes a parent. Genomic or other DNA from such other strains may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that hybridizes with SEQ ID NO: 1 or a subsequence thereof, the carrier material is used in a Southern blot.

For purposes of the present invention, hybridization indicates that the polynucleotide hybridizes to a labeled nucleic acid probe corresponding to (i) SEQ ID NO: 1; (ii) the mature polypeptide coding sequence of SEQ ID NO: 1; (iii) the full-length complement thereof; or (iv) a subsequence thereof; under very low to very high stringency conditions. Molecules to which the nucleic acid probe hybridizes under these conditions can be detected using, for example, X-ray film or any other detection means known in the art.

In one aspect, the nucleic acid probe is a polynucleotide that encodes the polypeptide of SEQ ID NO: 2; the mature polypeptide thereof; or a fragment thereof. In another aspect, the nucleic acid probe is SEQ ID NO: 1.

In another embodiment, the parent is encoded by a polynucleotide having a sequence identity to the mature polypeptide coding sequence of SEQ ID NO: 1 of at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100%.

The polypeptide may be a hybrid polypeptide in which a region of one polypeptide is fused at the N-terminus or the C-terminus of a region of another polypeptide.

The parent may be a fusion polypeptide or cleavable fusion polypeptide in which another polypeptide is fused at the N-terminus or the C-terminus of the polypeptide of the present invention. A fusion polypeptide is produced by fusing a polynucleotide encoding another polypeptide to a polynucleotide of the present invention. Techniques for producing fusion polypeptides are known in the art, and include ligating the coding sequences encoding the polypeptides so that they are in frame and that expression of the fusion polypeptide is under control of the same promoter(s) and terminator. Fusion polypeptides may also be constructed using intein technology in which fusion polypeptides are created post-translationally (Cooper et al., 1993, *EMBO J.* 12: 2575-2583; Dawson et al., 1994, *Science* 266: 776-779).

A fusion polypeptide can further comprise a cleavage site between the two polypeptides. Upon secretion of the fusion protein, the site is cleaved releasing the two polypeptides. Examples of cleavage sites include, but are not limited to, the sites disclosed in Martin et al., 2003, *J. Ind. Microbiol. Biotechnol.* 3: 568-576; Svetina et al., 2000, *J. Biotechnol.* 76: 245-251; Rasmussen-Wilson et al., 1997, *Appl. Environ. Microbiol.* 63: 3488-3493; Ward et al., 1995, *Biotechnology* 13: 498-503; and Contreras et al., 1991, *Biotechnology* 9: 378-381; Eaton et al., 1986, *Biochemistry* 25: 505-512; Collins-Racie et al., 1995, *Biotechnology* 13: 982-987; Carter et al., 1989, *Proteins: Structure, Function, and Genetics* 6: 240-248; and Stevens, 2003, *Drug Discovery World* 4: 35-48.

The parent may be obtained from microorganisms of any genus. For purposes of the present invention, the term "obtained from" as used herein in connection with a given source shall mean that the parent encoded by a polynucleotide is produced by the source or by a strain in which the polynucleotide from the source has been inserted. In one aspect, the parent is secreted extracellularly.

The parent may be an Aplysiidae (a family of rather large sea slugs and sea hares) organophosphorous hydrolase. Preferably, the parent is an *Aplysia* organophosphorous hydrolase; for example, the parent is an *Aplysia californica, Aplysia cedrocensis, Aplysia cervina, Aplysia cornigera, Aplysia cronullae, Aplysia dactylomela, Aplysia denisoni, Aplysia depilans, Aplysia dura, Aplysia euchlora, Aplysia extraordinaria, Aplysia fasciata, Aplysia gigantea, Aplysia gracilis, Aplysia inca, Aplysia juliana, Aplysia keraudreni, Aplysia kurodai, Aplysia maculate, Aplysia morio, Aplysia nigra, Aplysia nigra, Aplysia oculifera, Aplysia parvula, Aplysia pulmonica, Aplysia punctata, Aplysia rehderi, Aplysia reticulate, Aplysia reticulopoda, Aplysia robertsi, Aplysia rudmani, Aplysia sagamiana, Aplysia sibogae, Aplysia sowerbyi, Aplysia sydneyensis, Aplysia tanzanensis, Aplysia tigrinella,* or *Aplysia vaccaria* organophosphorous hydrolase.

In a preferred aspect, the parent is an *Aplysia californica* organophosphorous hydrolase, e.g., the organophosphorous hydrolase of SEQ ID NO: 2 or the mature polypeptide thereof.

It will be understood that for the aforementioned species, the invention encompasses both the perfect and imperfect states, and other taxonomic equivalents, e.g., anamorphs, regardless of the species name by which they are known. Those skilled in the art will readily recognize the identity of appropriate equivalents.

Strains of these species are readily accessible to the public in a number of culture collections, such as the American Type Culture Collection (ATCC), Deutsche Sammlung von Mikroorganismen and Zellkulturen GmbH (DSMZ), Centraalbureau Voor Schimmelcultures (CBS), and *Agricultural Research* Service Patent Culture Collection, Northern Regional Research Center (NRRL).

The parent may be identified and obtained from other sources including microorganisms isolated from nature (e.g., soil, composts, water, etc.) or DNA samples obtained directly from natural materials (e.g., soil, composts, water, etc.) using the above-mentioned probes. Techniques for isolating microorganisms and DNA directly from natural habitats are well known in the art. A polynucleotide encoding a parent may then be obtained by similarly screening a genomic DNA or cDNA library of another microorganism or mixed DNA sample. Once a polynucleotide encoding a parent has been detected with the probe(s), the polynucleotide can be isolated or cloned by utilizing techniques that are known to those of ordinary skill in the art (see, e.g., Sambrook et al., 1989, supra).

Preparation of Variants

The present invention also relates to methods for obtaining a variant having organophosphorous hydrolase activity, comprising: (a) introducing into a parent organophosphorous hydrolase a substitution at one or more (e.g., several) positions corresponding to positions K34, D37, D38, P58, G59, R61, D63, D91, I94, C96, M111, E164, F165, K166, M167, F169, Q170, E171, R193, F194, T216, R219, D243, E245, Q246, E247, G248, P250, W266, D290, K291, S293, and N312; preferably positions P58, R61, F165, M167, R193, P250, and N312 of the mature polypeptide of SEQ ID NO: 2, wherein the variant has organophosphorous hydrolase activity; and (b) recovering the variant.

The variants can be prepared using any mutagenesis procedure known in the art, such as site-directed mutagenesis, synthetic gene construction, semi-synthetic gene construction, random mutagenesis, shuffling, etc.

Site-directed mutagenesis is a technique in which one or more (e.g., several) mutations are introduced at one or more defined sites in a polynucleotide encoding the parent.

Site-directed mutagenesis can be accomplished in vitro by PCR involving the use of oligonucleotide primers containing the desired mutation. Site-directed mutagenesis can also be performed in vitro by cassette mutagenesis involving the cleavage by a restriction enzyme at a site in the plasmid comprising a polynucleotide encoding the parent and subsequent ligation of an oligonucleotide containing the mutation in the polynucleotide. Usually the restriction enzyme that digests the plasmid and the oligonucleotide is the same, permitting sticky ends of the plasmid and the insert to ligate to one another. See, e.g., Scherer and Davis, 1979, *Proc. Natl. Acad. Sci. USA* 76: 4949-4955; and Barton et al., 1990, *Nucleic Acids Res.* 18: 7349-4966.

Site-directed mutagenesis can also be accomplished in vivo by methods known in the art. See, e.g., U.S. Patent Application Publication No. 2004/0171154; Storici et al., 2001, *Nature Biotechnol.* 19: 773-776; Kren et al., 1998, *Nat. Med.* 4: 285-290; and Calissano and Macino, 1996, *Fungal Genet. Newslett.* 43: 15-16.

Any site-directed mutagenesis procedure can be used in the present invention. There are many commercial kits available that can be used to prepare variants.

Synthetic gene construction entails in vitro synthesis of a designed polynucleotide molecule to encode a polypeptide of interest. Gene synthesis can be performed utilizing a number of techniques, such as the multiplex microchip-based technology described by Tian et al. (2004, *Nature* 432: 1050-1054) and similar technologies wherein oligonucleotides are synthesized and assembled upon photo-programmable microfluidic chips.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204) and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active polypeptides can be recovered from the host cells and rapidly sequenced using standard methods in the art. These methods allow the rapid determination of the importance of individual amino acid residues in a polypeptide.

Semi-synthetic gene construction is accomplished by combining aspects of synthetic gene construction, and/or site-directed mutagenesis, and/or random mutagenesis, and/or shuffling. Semi-synthetic construction is typified by a process utilizing polynucleotide fragments that are synthesized, in combination with PCR techniques. Defined regions of genes may thus be synthesized de novo, while other regions may be amplified using site-specific mutagenic primers, while yet other regions may be subjected to error-prone PCR or non-error prone PCR amplification. Polynucleotide subsequences may then be shuffled.

Polynucleotides

The present invention also relates to polynucleotides encoding a variant of the present invention.

Nucleic Acid Constructs

The present invention also relates to nucleic acid constructs comprising a polynucleotide encoding a variant of the present invention operably linked to one or more control sequences that direct the expression of the coding sequence in a suitable host cell under conditions compatible with the control sequences.

The polynucleotide may be manipulated in a variety of ways to provide for expression of a variant. Manipulation of the polynucleotide prior to its insertion into a vector may be desirable or necessary depending on the expression vector. The techniques for modifying polynucleotides utilizing recombinant DNA methods are well known in the art.

The control sequence may be a promoter, a polynucleotide which is recognized by a host cell for expression of the polynucleotide. The promoter contains transcriptional control sequences that mediate the expression of the variant. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the nucleic acid constructs of the present invention in a bacterial host cell are the promoters obtained from the *Bacillus amyloliquefaciens* alpha-amylase gene (amyQ), *Bacillus licheniformis* alpha-amylase gene (amyL), *Bacillus licheniformis* penicillinase gene (penP), *Bacillus stearothermophilus* maltogenic amylase gene (amyM), *Bacillus subtilis* levansucrase gene (sacB), *Bacillus subtilis* xylA and xylB genes, *Bacillus thuringiensis* cryIIIA gene (Agaisse and Lereclus, 1994, *Molecular Microbiology* 13: 97-107), *E. coli* lac operon, *E. coli* trc promoter (Egon et al., 1988, *Gene* 69: 301-315), *Streptomyces coelicolor* agarase gene (dagA), and prokaryotic beta-lactamase gene (Villa-Kamaroff et al., 1978, *Proc. Natl. Acad. Sci. USA* 75: 3727-3731), as well as the tac promoter (DeBoer et al., 1983, *Proc. Natl. Acad. Sci. USA* 80: 21-25). Further promoters are described in "Useful proteins from recombinant bacteria" in Gilbert et al., 1980, *Scientific American* 242: 74-94; and in Sambrook et al., 1989, supra. Examples of tandem promoters are disclosed in WO 99/43835.

Examples of suitable promoters for directing transcription of the nucleic acid constructs of the present invention in a filamentous fungal host cell are promoters obtained from the genes for *Aspergillus nidulans* acetamidase, *Aspergillus niger* neutral alpha-amylase, *Aspergillus niger* acid stable alpha-amylase, *Aspergillus niger* or *Aspergillus awamori* glucoamylase (glaA), *Aspergillus oryzae* TAKA amylase, *Aspergillus oryzae* alkaline protease, *Aspergillus oryzae* triose phosphate isomerase, *Fusarium oxysporum* trypsin-like protease (WO 96/00787), *Fusarium venenatum* amyloglucosidase (WO 00/56900), *Fusarium venenatum* Daria (WO 00/56900), *Fusarium venenatum* Quinn (WO 00/56900), *Rhizomucor miehei* lipase, *Rhizomucor miehei* aspartic proteinase, *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase IV, *Trichoderma reesei* endoglucanase V, *Trichoderma reesei* xylanase I, *Trichoderma reesei* xylanase II, *Trichoderma reesei* beta-xylosidase, as well as the NA2-tpi promoter (a modified promoter from an *Aspergillus* neutral alpha-amylase gene in which the untranslated leader has been replaced by an untranslated leader from an *Aspergillus* triose phosphate isomerase gene; non-limiting examples include modified promoters from an *Aspergillus niger* neutral alpha-amylase gene in which the untranslated leader has been replaced by an untranslated leader from an *Aspergillus nidulans* or *Aspergillus oryzae* triose phosphate isomerase gene); and mutant, truncated, and hybrid promoters thereof.

In a yeast host, useful promoters are obtained from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), and *Saccharomyces cerevisiae* 3-phosphoglycerate kinase. Other useful promoters for yeast host cells are described by Romanos et al., 1992, *Yeast* 8: 423-488.

The control sequence may also be a transcription terminator, which is recognized by a host cell to terminate transcription. The terminator sequence is operably linked to the 3'-terminus of the polynucleotide encoding the variant. Any terminator that is functional in the host cell may be used.

Preferred terminators for bacterial host cells are obtained from the genes for *Bacillus clausii* alkaline protease (aprH), *Bacillus licheniformis* alpha-amylase (amyL), and *Escherichia coli* ribosomal RNA (rrnB).

Preferred terminators for filamentous fungal host cells are obtained from the genes for *Aspergillus nidulans* anthranilate synthase, *Aspergillus nigerglucoamylase, Aspergillus niger* alpha-glucosidase, *Aspergillus oryzae* TAKA amylase, and *Fusarium oxysporum* trypsin-like protease.

Preferred terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence may also be an mRNA stabilizer region downstream of a promoter and upstream of the coding sequence of a gene which increases expression of the gene.

Examples of suitable mRNA stabilizer regions are obtained from a *Bacillus thuringiensis* ctyllIA gene (WO 94/25612) and a *Bacillus subtilis* SP82 gene (Hue et al., 1995, *Journal of Bacteriology* 177: 3465-3471).

The control sequence may also be a leader, a nontranslated region of an mRNA that is important for translation by the host cell. The leader sequence is operably linked to the 5'-terminus of the polynucleotide encoding the variant. Any leader that is functional in the host cell may be used.

Preferred leaders for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3'-terminus of the variant-encoding sequence and, when transcribed, is recognized by the host cell as a signal to add polyadenosine residues to transcribed mRNA. Any polyadenylation sequence that is functional in the host cell may be used.

Preferred polyadenylation sequences for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

Useful polyadenylation sequences for yeast host cells are described by Guo and Sherman, 1995, *Mol. Cellular Biol.* 15: 5983-5990.

The control sequence may also be a signal peptide coding region that encodes a signal peptide linked to the N-terminus of a variant and directs the variant into the cell's secretory pathway. The 5'-end of the coding sequence of the polynucleotide may inherently contain a signal peptide coding sequence naturally linked in translation reading frame with the segment of the coding sequence that encodes the variant. Alternatively, the 5'-end of the coding sequence may contain a signal peptide coding sequence that is foreign to the coding sequence. A foreign signal peptide coding sequence may be required where the coding sequence does not naturally contain a signal peptide coding sequence. Alternatively, a foreign signal peptide coding sequence may simply replace the natural signal peptide coding sequence in order to enhance secretion of the variant. However, any signal peptide coding sequence that directs the expressed variant into the secretory pathway of a host cell may be used.

Effective signal peptide coding sequences for bacterial host cells are the signal peptide coding sequences obtained from the genes for *Bacillus* NCIB 11837 maltogenic amylase, *Bacillus licheniformis* subtilisin, *Bacillus licheniformis* beta-lactamase, *Bacillus stearothermophilus* alpha-amylase, *Bacillus stearothermophilus* neutral proteases (nprT, nprS, nprM), and *Bacillus subtilis* prsA. Further signal peptides are described by Simonen and Palva, 1993, *Microbiological Reviews* 57: 109-137.

Effective signal peptide coding sequences for filamentous fungal host cells are the signal peptide coding sequences obtained from the genes for *Aspergillus niger* neutral amylase, *Aspergillus niger* glucoamylase, *Aspergillus oryzae* TAKA amylase, *Humicola insolens* cellulase, *Humicola insolens* endoglucanase V, *Humicola lanuginosa* lipase, and *Rhizomucor miehei* aspartic proteinase.

Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra.

The control sequence may also be a propeptide coding sequence that encodes a propeptide positioned at the N-terminus of a variant. The resultant polypeptide is known as a proenzyme or propolypeptide (or a zymogen in some cases). A propolypeptide is generally inactive and can be converted to an active polypeptide by catalytic or autocatalytic cleavage of the propeptide from the propolypeptide. The propeptide coding sequence may be obtained from the genes for *Bacillus subtilis* alkaline protease (aprE), *Bacillus subtilis* neutral protease (nprT), *Myceliophthora thermophila* laccase (WO 95/33836), *Rhizomucor miehei* aspartic proteinase, and *Saccharomyces cerevisiae* alpha-factor.

Where both signal peptide and propeptide sequences are present, the propeptide sequence is positioned next to the N-terminus of the variant and the signal peptide sequence is positioned next to the N-terminus of the propeptide sequence.

It may also be desirable to add regulatory sequences that regulate expression of the variant relative to the growth of the host cell. Examples of regulatory systems are those that cause expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. In filamentous fungi, the *Aspergillus niger* glucoamylase promoter, *Aspergillus oryzae* TAKA alpha-amylase promoter, and *Aspergillus oryzae* glucoamylase promoter may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the variant would be operably linked with the regulatory sequence.

Expression Vectors

The present invention also relates to recombinant expression vectors comprising a polynucleotide encoding a variant of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the variant at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used.

The vector preferably contains one or more selectable markers that permit easy selection of transformed, transfected, transduced, or the like cells. A selectable marker is a gene the product of which provides for biocide or viral resistance, resistance to heavy metals, prototrophy to auxotrophs, and the like.

Examples of bacterial selectable markers are *Bacillus licheniformis* or *Bacillus subtilis* dal genes, or markers that confer antibiotic resistance such as ampicillin, chloramphenicol, kanamycin, neomycin, spectinomycin or tetracycline resistance. Suitable markers for yeast host cells include, but are not limited to, ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5′-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene.

The vector preferably contains an element(s) that permits integration of the vector into the host cell's genome or autonomous replication of the vector in the cell independent of the genome.

For integration into the host cell genome, the vector may rely on the polynucleotide's sequence encoding the variant or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector may further comprise an origin of replication enabling the vector to replicate autonomously in the host cell in question. The origin of replication may be any plasmid replicator mediating autonomous replication that functions in a cell. The term "origin of replication" or "plasmid replicator" means a polynucleotide that enables a plasmid or vector to replicate in vivo.

Examples of bacterial origins of replication are the origins of replication of plasmids pBR322, pUC19, pACYC177, and pACYC184 permitting replication in *E. coli*, and pUB110, pE194, pTA1060, and pAMβ1 permitting replication in *Bacillus*.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANSI (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention may be inserted into a host cell to increase production of a variant. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

Host Cells

The present invention also relates to recombinant host cells, comprising a polynucleotide encoding a variant of the present invention operably linked to one or more control sequences that direct the production of a variant of the present invention. A construct or vector comprising a polynucleotide is introduced into a host cell so that the construct or vector is maintained as a chromosomal integrant or as a self-replicating extra-chromosomal vector as described earlier. The term "host cell" encompasses any progeny of a parent cell that is not identical to the parent cell due to mutations that occur during replication. The choice of a host cell will to a large extent depend upon the gene encoding the variant and its source.

The host cell may be any cell useful in the recombinant production of a variant, e.g., a prokaryote or a eukaryote.

The prokaryotic host cell may be any Gram-positive or Gram-negative bacterium. Gram-positive bacteria include, but are not limited to, *Bacillus, Clostridium, Enterococcus,*

*Geobacillus, Lactobacillus, Lactococcus, Oceanobacillus, Staphylococcus, Streptococcus*, and *Streptomyces*. Gram-negative bacteria include, but are not limited to, *Campylobacter, E. coli, Flavobacterium, Fusobacterium, Helicobacter, Ilyobacter, Neisseria, Pseudomonas, Salmonella*, and *Ureaplasma*.

The bacterial host cell may be any *Bacillus* cell including, but not limited to, *Bacillus alkalophilus, Bacillus amyloliquefaciens, Bacillus brevis, Bacillus circulans, Bacillus clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis*, and *Bacillus thuringiensis* cells.

The bacterial host cell may also be any *Streptococcus* cell including, but not limited to, *Streptococcus equisimilis, Streptococcus pyogenes, Streptococcus uberis*, and *Streptococcus equi* subsp. *Zooepidemicus* cells.

The bacterial host cell may also be any *Streptomyces* cell, including, but not limited to, *Streptomyces achromogenes, Streptomyces avermitilis, Streptomyces coelicolor, Streptomyces griseus*, and *Streptomyces lividans* cells.

The introduction of DNA into a *Bacillus* cell may be effected by protoplast transformation (see, e.g., Chang and Cohen, 1979, *Mol. Gen. Genet.* 168: 111-115), competent cell transformation (see, e.g., Young and Spizizen, 1961, *J. Bacteriol.* 81: 823-829, or Dubnau and Davidoff-Abelson, 1971, *J. Mol. Biol.* 56: 209-221), electroporation (see, e.g., Shigekawa and Dower, 1988, *Biotechniques* 6: 742-751), or conjugation (see, e.g., Koehler and Thorne, 1987, *J. Bacteriol.* 169: 5271-5278). The introduction of DNA into an *E. coli* cell may be effected by protoplast transformation (see, e.g., Hanahan, 1983, *J. Mol. Biol.* 166: 557-580) or electroporation (see, e.g., Dower et al., 1988, *Nucleic Acids Res.* 16: 6127-6145). The introduction of DNA into a *Streptomyces* cell may be effected by protoplast transformation, electroporation (see, e.g., Gong et al., 2004, *Folia Microbiol.* (Praha) 49: 399-405), conjugation (see, e.g., Mazodier et al., 1989, *J. Bacteriol.* 171: 3583-3585), or transduction (see, e.g., Burke et al., 2001, *Proc. Natl. Acad. Sci. USA* 98: 6289-6294). The introduction of DNA into a *Pseudomonas* cell may be effected by electroporation (see, e.g., Choi et al., 2006, *J. Microbiol. Methods* 64: 391-397), or conjugation (see, e.g., Pinedo and Smets, 2005, *Appl. Environ. Microbiol.* 71: 51-57). The introduction of DNA into a *Streptococcus* cell may be effected by natural competence (see, e.g., Perry and Kuramitsu, 1981, *Infect. Immun.* 32: 1295-1297), protoplast transformation (see, e.g., Catt and Jollick, 1991, *Microbios* 68: 189-207), electroporation (see, e.g., Buckley et al., 1999, *Appl. Environ. Microbiol.* 65: 3800-3804) or conjugation (see, e.g., Clewell, 1981, *Microbiol. Rev.* 45: 409-436). However, any method known in the art for introducing DNA into a host cell can be used.

The host cell may also be a eukaryote, such as a mammalian, insect, plant, or fungal cell. The host cell may be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, *Ainsworth and Bisby's Dictionary of The Fungi*, 8th edition, 1995, CAB International, University Press, Cambridge, UK).

The fungal host cell may be a yeast cell. "Yeast" as used herein includes ascosporogenous yeast (Endomycetales), basidiosporogenous yeast, and yeast belonging to the Fungi Imperfecti (Blastomycetes). Since the classification of yeast may change in the future, for the purposes of this invention, yeast shall be defined as described in Biology and Activities of Yeast (Skinner, Passmore, and Davenport, editors, *Soc. App. Bacteriol. Symposium Series No. 9*, 1980).

The yeast host cell may be a *Candida, Hansenula, Kluyveromyces, Pichia, Saccharomyces, Schizosaccharomyces*, or *Yarrowia* cell such as a *Kluyveromyces lactis, Saccharomyces carlsbergensis, Saccharomyces cerevisiae, Saccharomyces diastaticus, Saccharomyces douglasii, Saccharomyces kluyveri, Saccharomyces norbensis, Saccharomyces oviformis*, or *Yarrowia lipolytica* cell.

The fungal host cell may be a filamentous fungal cell. "Filamentous fungi" include all filamentous forms of the subdivision Eumycota and Oomycota (as defined by Hawksworth et al., 1995, supra). The filamentous fungi are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

The filamentous fungal host cell may be an *Acremonium, Aspergillus, Aureobasidium, Bjerkandera, Ceriporiopsis, Chrysosporium, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phlebia, Piromyces, Pleurotus, Schizophyllum, Talaromyces, Thermoascus, Thielavia, Tolypocladium, Trametes*, or *Trichoderma* cell.

For example, the filamentous fungal host cell may be an *Aspergillus awamori, Aspergillus foetidus, Aspergillus fumigatus, Aspergillus japonicus, Aspergillus nidulans, Aspergillus niger, Aspergillus oryzae, Bjerkandera adusta, Ceriporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Chrysosporium inops, Chrysosporium keratinophilum, Chrysosporium lucknowense, Chrysosporium merdarium, Chrysosporium pannicola, Chrysosporium queenslandicum, Chrysosporium tropicum, Chrysosporium zonatum, Coprinus cinereus, Coriolus hirsutus, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Thielavia terrestris, Trametes villosa, Trametes versicolor, Trichoderma harzianum, Trichoderma koningii, Trichoderma longibrachiatum, Trichoderma reesei*, or *Trichoderma viride* cell.

Fungal cells may be transformed by a process involving protoplast formation, transformation of the protoplasts, and regeneration of the cell wall in a manner known per se. Suitable procedures for transformation of *Aspergillus* and *Trichoderma* host cells are described in EP 238023, Yelton et al., 1984, *Proc. Natl. Acad. Sci. USA* 81: 1470-1474, and Christensen et al., 1988, *Bio/Technology* 6: 1419-1422. Suitable methods for transforming *Fusarium* species are described by Malardier et al., 1989, *Gene* 78: 147-156, and WO 96/00787. Yeast may be transformed using the procedures described by Becker and Guarente, In Abelson, J. N. and Simon, M. I., editors, *Guide to Yeast Genetics and*

*Molecular Biology, Methods in Enzymology,* Volume 194, pp 182-187, Academic Press, Inc., New York; Ito et al., 1983, *J. Bacteriol.* 153: 163; and Hinnen et al., 1978, *Proc. Natl. Acad. Sci. USA* 75: 1920.

Methods of Production

The present invention also relates to methods of producing a variant, comprising: (a) cultivating a host cell of the present invention under conditions suitable for expression of the variant; and (b) recovering the variant.

The host cells are cultivated in a nutrient medium suitable for production of the variant using methods known in the art. For example, the cell may be cultivated by shake flask cultivation, or small-scale or large-scale fermentation (including continuous, batch, fed-batch, or solid state fermentations) in laboratory or industrial fermentors performed in a suitable medium and under conditions allowing the variant to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). If the variant is secreted into the nutrient medium, the variant can be recovered directly from the medium. If the variant is not secreted, it can be recovered from cell lysates.

The variant may be detected using methods known in the art that are specific for the variants (see also Example 1). These detection methods include, but are not limited to, use of specific antibodies, formation of an enzyme product, or disappearance of an enzyme substrate. For example, an enzyme assay may be used to determine the activity of the variant.

The variant may be recovered using methods known in the art. For example, the variant may be recovered from the nutrient medium by conventional procedures including, but not limited to, collection, centrifugation, filtration, extraction, spray-drying, evaporation, or precipitation.

The variant may be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., *Protein Purification*, Janson and Ryden, editors, VCH Publishers, New York, 1989) to obtain substantially pure variants.

In an alternative aspect, the variant is not recovered, but rather a host cell of the present invention expressing the variant is used as a source of the variant.

Plants

The present invention also relates to plants, e.g., a transgenic plant, plant part, or plant cell, comprising a polynucleotide of the present invention so as to express and produce the variant in recoverable quantities. The variant may be recovered from the plant or plant part. Alternatively, the plant or plant part containing the variant may be used as such for improving the quality of a food or feed, e.g., improving nutritional value, palatability, and rheological properties, or to destroy an antinutritive factor.

The transgenic plant can be dicotyledonous (a dicot) or monocotyledonous (a monocot). Examples of monocot plants are grasses, such as meadow grass (blue grass, Poa), forage grass such as *Festuca, Lolium*, temperate grass, such as *Agrostis*, and cereals, e.g., wheat, oats, rye, barley, rice, sorghum, and maize (corn).

Examples of dicot plants are tobacco, legumes, such as lupins, potato, sugar beet, pea, bean and soybean, and cruciferous plants (family Brassicaceae), such as cauliflower, rape seed, and the closely related model organism *Arabidopsis thaliana*.

Examples of plant parts are stem, callus, leaves, root, fruits, seeds, and tubers as well as the individual tissues comprising these parts, e.g., epidermis, mesophyll, parenchyme, vascular tissues, meristems. Specific plant cell compartments, such as chloroplasts, apoplasts, mitochondria, vacuoles, peroxisomes and cytoplasm are also considered to be a plant part. Furthermore, any plant cell, whatever the tissue origin, is considered to be a plant part. Likewise, plant parts such as specific tissues and cells isolated to facilitate the utilization of the invention are also considered plant parts, e.g., embryos, endosperms, aleurone and seed coats.

Also included within the scope of the present invention are the progeny of such plants, plant parts, and plant cells.

The transgenic plant or plant cell expressing a variant may be constructed in accordance with methods known in the art. In short, the plant or plant cell is constructed by incorporating one or more expression constructs encoding a variant into the plant host genome or chloroplast genome and propagating the resulting modified plant or plant cell into a transgenic plant or plant cell.

The expression construct is conveniently a nucleic acid construct that comprises a polynucleotide encoding a variant operably linked with appropriate regulatory sequences required for expression of the polynucleotide in the plant or plant part of choice. Furthermore, the expression construct may comprise a selectable marker useful for identifying plant cells into which the expression construct has been integrated and DNA sequences necessary for introduction of the construct into the plant in question (the latter depends on the DNA introduction method to be used).

The choice of regulatory sequences, such as promoter and terminator sequences and optionally signal or transit sequences, is determined, for example, on the basis of when, where, and how the variant is desired to be expressed. For instance, the expression of the gene encoding a variant may be constitutive or inducible, or may be developmental, stage or tissue specific, and the gene product may be targeted to a specific tissue or plant part such as seeds or leaves. Regulatory sequences are, for example, described by Tague et al., 1988, *Plant Physiology* 86: 506.

For constitutive expression, the 35S-CaMV, the maize ubiquitin 1, or the rice actin 1 promoter may be used (Franck et al., 1980, *Cell* 121: 285-294; Christensen et al., 1992, *Plant Mol. Biol.* 18: 675-689; Zhang et al., 1991, *Plant Cell* 3: 1155-1165). Organ-specific promoters may be, for example, a promoter from storage sink tissues such as seeds, potato tubers, and fruits (Edwards and Coruzzi, 1990, *Ann. Rev. Genet.* 24: 275-303), or from metabolic sink tissues such as meristems (Ito et al., 1994, *Plant Mol. Biol.* 24: 863-878), a seed specific promoter such as the glutelin, prolamin, globulin, or albumin promoter from rice (Wu et al., 1998, *Plant Cell Physiol.* 39: 885-889), a *Vicia faba* promoter from the legumin B4 and the unknown seed protein gene from *Vicia faba* (Conrad et al., 1998, *J. Plant Physiol.* 152: 708-711), a promoter from a seed oil body protein (Chen et al., 1998, *Plant Cell Physiol.* 39: 935-941), the storage protein napA promoter from *Brassica napus*, or any other seed specific promoter known in the art, e.g., as described in WO 91/14772. Furthermore, the promoter may be a leaf specific promoter such as the rbcs promoter from rice or tomato (Kyozuka et al., 1993, *Plant Physiol.* 102: 991-1000), the *chlorella* virus adenine methyltransferase gene promoter (Mitra and Higgins, 1994, *Plant Mol. Biol.* 26: 85-93), the aldP gene promoter from rice (Kagaya et al., 1995, *Mol. Gen. Genet.* 248: 668-674), or a wound inducible promoter such as the potato pin2 promoter (Xu et al., 1993, *Plant Mol. Biol.* 22: 573-588). Likewise, the promoter may be induced by abiotic treatments such as temperature, drought, or alterations in salinity or induced by exogenously applied substances that activate the promoter, e.g., ethanol, oestrogens, plant hormones such as ethylene, abscisic acid, and gibberellic acid, and heavy metals.

A promoter enhancer element may also be used to achieve higher expression of a variant in the plant. For instance, the promoter enhancer element may be an intron that is placed between the promoter and the polynucleotide encoding a variant. For instance, Xu et al., 1993, supra, disclose the use of the first intron of the rice actin 1 gene to enhance expression.

The selectable marker gene and any other parts of the expression construct may be chosen from those available in the art.

The nucleic acid construct is incorporated into the plant genome according to conventional techniques known in the art, including *Agrobacterium*-mediated transformation, virus-mediated transformation, microinjection, particle bombardment, biolistic transformation, and electroporation (Gasser et al., 1990, *Science* 244: 1293; Potrykus, 1990, *Bio/Technology* 8: 535; Shimamoto et al., 1989, *Nature* 338: 274).

*Agrobacterium tumefaciens*-mediated gene transfer is a method for generating transgenic dicots (for a review, see Hooykas and Schilperoort, 1992, *Plant Mol. Biol.* 19: 15-38) and for transforming monocots, although other transformation methods may be used for these plants. A method for generating transgenic monocots is particle bombardment (microscopic gold or tungsten particles coated with the transforming DNA) of embryonic calli or developing embryos (Christou, 1992, *Plant J.* 2: 275-281; Shimamoto, 1994, *Curr. Opin. Biotechnol.* 5: 158-162; Vasil et al., 1992, *Bio/Technology* 10: 667-674). An alternative method for transformation of monocots is based on protoplast transformation as described by Omirulleh et al., 1993, *Plant Mol. Biol.* 21: 415-428. Additional transformation methods include those described in U.S. Pat. Nos. 6,395,966 and 7,151,204 (both of which are herein incorporated by reference in their entirety).

Following transformation, the transformants having incorporated the expression construct are selected and regenerated into whole plants according to methods well known in the art. Often the transformation procedure is designed for the selective elimination of selection genes either during regeneration or in the following generations by using, for example, co-transformation with two separate T-DNA constructs or site specific excision of the selection gene by a specific recombinase.

In addition to direct transformation of a particular plant genotype with a construct of the present invention, transgenic plants may be made by crossing a plant having the construct to a second plant lacking the construct. For example, a construct encoding a variant can be introduced into a particular plant variety by crossing, without the need for ever directly transforming a plant of that given variety. Therefore, the present invention encompasses not only a plant directly regenerated from cells which have been transformed in accordance with the present invention, but also the progeny of such plants. As used herein, progeny may refer to the offspring of any generation of a parent plant prepared in accordance with the present invention. Such progeny may include a DNA construct prepared in accordance with the present invention. Crossing results in the introduction of a transgene into a plant line by cross pollinating a starting line with a donor plant line. Non-limiting examples of such steps are described in U.S. Pat. No. 7,151,204.

Plants may be generated through a process of backcross conversion. For example, plants include plants referred to as a backcross converted genotype, line, inbred, or hybrid.

Genetic markers may be used to assist in the introgression of one or more transgenes of the invention from one genetic background into another. Marker assisted selection offers advantages relative to conventional breeding in that it can be used to avoid errors caused by phenotypic variations. Further, genetic markers may provide data regarding the relative degree of elite germplasm in the individual progeny of a particular cross. For example, when a plant with a desired trait which otherwise has a non-agronomically desirable genetic background is crossed to an elite parent, genetic markers may be used to select progeny which not only possess the trait of interest, but also have a relatively large proportion of the desired germplasm. In this way, the number of generations required to introgress one or more traits into a particular genetic background is minimized.

The present invention also relates to methods of producing a variant of the present invention comprising: (a) cultivating a transgenic plant or a plant cell comprising a polynucleotide encoding the variant under conditions conducive for production of the variant; and (b) recovering the variant.

Compositions

The present invention also relates to compositions comprising a polypeptide of the present invention. The compositions may be prepared in accordance with methods known in the art and may be in the form of a liquid or a dry composition. For instance, the polypeptide composition may be in the form of a granulate or a microgranulate. The polypeptide to be included in the composition may be stabilized in accordance with methods known in the art.

Examples are given below of preferred uses of the polypeptide compositions of the invention. The dosage of the polypeptide composition of the invention and other conditions under which the composition is used may be determined on the basis of methods known in the art.

Uses

The present invention is also directed to methods for using the polypeptides having organophosphorous hydrolase activity (organophosphorous hydrolases), or compositions thereof.

In one preferred embodiment the invention also directed to the use of organophosphorous hydrolases of the invention for decontaminating an area or a device contaminated with at least one harmful or undesired organophosphorous compound. The organophosphorous hydrolases of the invention or a composition comprising the organophosphorous hydrolases of the invention is applied to the area or the device in an amount sufficient to degrade at least part of at least one harmful or undesired organophosphorous compound.

In another embodiment the organophosphorous hydrolases of the invention may be used emulsions such as micro emulsions for applying to e.g. a human or animals. The organophosphorous hydrolases of the invention or a composition comprising the organophosphorous hydrolases of the invention is applied to the human or animal to protect against at least one harmful or undesired organophosphorous compound.

In a further embodiment the organophosphorous hydrolases of the invention may be incorporated in an assay for detection of at least one harmful or undesired organophosphorous compound. Such assays could be beneficial for quick assessment of the presence of undesired organophosphorous compound Harmful or undesired organophosphorous compounds includes toxic organophosphorous cholinesterase-inhibiting compounds including nerve gases (G agents or G-series) such as ethyl N,N-dimethylphosphoramidocyanidate (tabun), diisopropylfluorophosphate (DFP), O-isopropyl methylphosphonofluoridate (sarin), O-pinacolyl methyl phosphonofluoridate (soman) and O-cyclohexyl methylphosphonofluoridate.

Other harmful compounds includes V agents (or V-series), which may comprise VX, VE, VG, VM, VR Tetriso and Soviet V-gas (Russian VX).

The pesticides may comprise fungicides, insecticides, herbicide and rodenticides. The pesticide may be Demeton-S, Demeton-S-methyl, Demeton-S-methylsulphon, Demeton-methyl, Parathion, Phosmet, Carbophenothion, Benoxafos, Azinphos-methyl, Azinphos-ethyl, Amiton, Amidithion, Cyanthoate, Dialiphos, Dimethoate, Dioxathion, Disulfoton, Endothion, Etion, Ethoate-methyl, Formothion, Malathion, Mercarbam, Omethoate, Oxydeprofos, Oxydisulfoton, Phenkapton, Phorate, Phosalone, Prothidathion, Prothoate, Sophamide, Thiometon, Vamidothion, Methamidophos.

The invention is further defined in the following paragraphs:

Embodiment 1

An organophosphorous hydrolase variant, comprising a substitution at one or more positions corresponding to positions K34, D37, D38, P58, G59, R61, D63, D91, I94, C96, M111, E164, F165, K166, M167, F169, Q170, E171, R193, F194, T216, R219, D243, E245, Q246, E247, G248, P250, W266, D290, K291, S293, and N312; preferably positions P58, R61, F165, M167, R193, P250, and N312 of the mature polypeptide of SEQ ID NO: 2, wherein the variant has organophosphorous hydrolase activity and wherein the variant has at least 60%, e.g., at least 65%, at least 70%, at least 75%, at least 80%, at least 85%, at least 90%, at least 95%, at least 96%, at least 97%, at least 98%, or at least 99%, but less than 100% sequence identity to the mature polypeptide of SEQ ID NO: 2.

Embodiment 2

The variant of embodiment 1, which is a variant of a parent organophosphorous hydrolase selected from the group consisting of:
(a) a polypeptide having at least 60% sequence identity to the mature polypeptide of SEQ ID NO: 2;
(b) a polypeptide encoded by a polynucleotide that hybridizes under low stringency conditions with (i) the mature polypeptide coding sequence of SEQ ID NO: 1, or (ii) the full-length complement of (i);
(c) a polypeptide encoded by a polynucleotide having at least 60% identity to the mature polypeptide coding sequence of SEQ ID NO: 1; and
(d) a fragment of the mature polypeptide of SEQ ID NO: 2, which has organophosphorous hydrolase activity.

Embodiment 3

The variant of embodiment 1, which is a variant of a parent organophosphorous hydrolase selected from the group consisting of:
(a) a polypeptide having at least 60% sequence identity to the mature polypeptide of SEQ ID NO: 4;
(b) a polypeptide encoded by a polynucleotide that hybridizes under low stringency conditions with (i) the mature polypeptide coding sequence of SEQ ID NO: 3, or (ii) the full-length complement of (i);
(c) a polypeptide encoded by a polynucleotide having at least 60% identity to the mature polypeptide coding sequence of SEQ ID NO: 3; and
(d) a fragment of the mature polypeptide of SEQ ID NO: 4, which has organophosphorous hydrolase activity.

Embodiment 4

The variant of embodiment 2, wherein the parent organophosphorous hydrolase has at least 60%, e.g., at least 65%, at least 70%, at least 75%, at least 80%, at least 85%, at least 90%, at least 95%, at least 96%, at least 97%, at least 98%, at least 99% or 100% sequence identity to the mature polypeptide of SEQ ID NO: 2.

Embodiment 5

The variant of embodiment 3, wherein the parent organophosphorous hydrolase has at least 60%, e.g., at least 65%, at least 70%, at least 75%, at least 80%, at least 85%, at least 90%, at least 95%, at least 96%, at least 97%, at least 98%, at least 99% or 100% sequence identity to the mature polypeptide of SEQ ID NO: 4.

Embodiment 6

The variant of embodiment 2, wherein the parent organophosphorous hydrolase comprises or consists of the mature polypeptide of SEQ ID NO: 2.

Embodiment 7

The variant of embodiment 2, wherein the parent organophosphorous hydrolase is a fragment of the mature polypeptide of SEQ ID NO: 2, wherein the fragment has organophosphorous hydrolase activity.

Embodiment 8

The variant of embodiment 3, wherein the parent organophosphorous hydrolase comprises or consists of the mature polypeptide of SEQ ID NO: 4.

Embodiment 9

The variant of embodiment 3, wherein the parent organophosphorous hydrolase is a fragment of the mature polypeptide of SEQ ID NO: 4, wherein the fragment has organophosphorous hydrolase activity.

Embodiment 10

The variant of any of embodiments 2-9, which has at least 60%, e.g., at least 65%, at least 70%, at least 75%, at least 80%, at least 85%, at least 90%, at least 95% identity, at least 96%, at least 97%, at least 98%, or at least 99%, but less than 100%, sequence identity to the amino acid sequence of the parent organophosphorous hydrolase.

Embodiment 11

The variant of any of embodiments 1-10, wherein the number of substitutions is 1-20, e.g., 1-10 and 1-5, such as 1, 2, 3, 4, 5, 6, 7, 8, 9 or 10 alterations.

Embodiment 12

The variant of any of embodiments 1-11, which comprises a substitution at a position corresponding to position P58; preferably the substitution is Ala, Gly, Met, Ser, or Val.

Embodiment 13

The variant of any of embodiments 1-12, which comprises a substitution at a position corresponding to position R61; preferably the substitution is Ile, Leu, Asn, Pro, or Val.

Embodiment 14

The variant of any of embodiments 1-13, which comprises a substitution at a position corresponding to position F165; preferably the substitution is Ala, Gly, Ile, Leu, Met, Ser, or Val.

Embodiment 15

The variant of any of embodiments 1-14, which comprises a substitution at a position corresponding to position M167; preferably the substitution is Ala, Gly, Ile, Ser, or Val.

Embodiment 16

The variant of any of embodiments 1-15, which comprises a substitution at a position corresponding to position R193; preferably the substitution is Asn or Gln.

Embodiment 17

The variant of any of embodiments 1-16, which comprises a substitution at a position corresponding to position P250; preferably the substitution is Ala, Gly, Ile, or Met.

Embodiment 18

The variant of any of embodiments 1-17, which comprises a substitution at a position corresponding to position N312; preferably the substitution is Asp.

Embodiment 19

The variant of any of embodiments 1-18, which comprises a substitution at two positions corresponding to any of positions P58, R61, F165, M167, R193, P250, and N312.

Embodiment 20

The variant of any of embodiments 1-19, which comprises a substitution at three positions corresponding to any of positions P58, R61, F165, M167, R193, P250, and N312.

Embodiment 21

The variant of any of embodiments 1-20, which comprises a substitution at four positions corresponding to any of positions P58, R61, F165, M167, R193, P250, and N312.

Embodiment 22

The variant of any of embodiments 1-21, which comprises a substitution at five positions corresponding to any of positions P58, R61, F165, M167, R193, P250, and N312.

Embodiment 23

The variant of any of embodiments 1-22, which comprises a substitution at six positions corresponding to any of positions P58, R61, F165, M167, R193, P250, and N312.

Embodiment 24

The variant of any of embodiments 1-23, which comprises a substitution at each position corresponding to positions P58, R61, M167, F165, R193, P250, and N312.

Embodiment 25

The variant of any of embodiments 1-24, which comprises one or more substitutions corresponding to substitutions selected from the group consisting of K34A, D37A, D37N, D37S, D37T, D38A, D38E, D38N, P58A, P58G, P58M, P58S, P58V, G59A, G59P, G59S, G59T, R61I, R61L, R61N, R61P, R61V, D63E, D63N, D63R, D91N, D91S, D91T, I94A, I94F, I94G, I94V, C96A, C96G, M111A, M111G, E164A, E164P, F165A, F165G, F165I, F165L, F165M, F165S, F165V, K166S, K166T, M167A, M167G, M167I, M167S, M167V, F169I, F169L, F169V, F169W, F169Y, Q170D, Q170E, Q170N, E171A, E171Q, R193N, R193Q, F194A, F194W, T216A, T216M, T216V, R219A, R219K, R219S, R219T, D243A, D243G, D243N, D243Q, E245D, E245Q, Q246A, Q246S, Q246T, E247A, E247D, E247Q, E247W, G248A, G248V, P250A, P250G, P250I, P250M, W266F, D290A, D290E, D290N, D290Q, K291A, K291T, S293T, and N312D.

Embodiment 26

The variant of any of embodiments 1-25, comprising a substitution corresponding to F169I, W266F, C96A, E171Q, Q246S, R193Q, K291T, F169Y, F169W, T216A, G248V, P58G, M111A, G248A, I94V, I94A, C96G, I94G, G59P, G59T, F194A, P58V, F165G, M167I, G59S, M111G, P250G, P58M, T216M, F165L, P250A, E247W, F165M, N312D, P58S, T216V, M167V, P58A, F194W, M167S, R61L, R61P, R61N, I94F, R61I, F165I, R61V, F165A, F165V, F165S, M167G, M167A, D38A+M167A, P250I+M167A, E247A+M167A, P250M+M167A, D91N+M167A, R219S+M167A, D37N+M167A, K34A+M167A, E164P+M167A, R219A+M167A, R61L+M167A, F165A+M167A, D91S+M167A, D37T+M167A, R219T+M167A, K166S+M167A, Q170E+M167A, D37S+M167A, K166T+M167A, D63N+M167A, F165S+M167A, D91T+M167A, K291A+M167A, Q246A+M167A, E247Q+M167A, D37A+M167A, Q246T+M167A, D38E+M167A, D38N+M167A, E247D+M167A, E171Q+M167A, K291T+M167A, D243A+M167A, D290N+M167A, D290Q+M167A, Q246S+M167A, R219K+M167A, D63R+M167A, D290A+M167A, D63E+M167A, R193N+M167A, E245D+M167A, D290E+

M167A, E164A+M167A, D243Q+M167A, D243G+M167A, D243N+M167A, E245Q+M167A, Q170D+M167A, E171A+M167A, Q170N+M167A, P250A+M167A, P250G+M167A, R193Q+M167A, N312D+M167A, R61V+M167A+P250G, W266F+M167A+P250G, R61L+N312D+M167A,I94F+M167A+P250G, N312D+M167A+P250G, R61N+M167A+P250G, R193Q+M167A+P250G, E171Q+M167A+P250G, F165V+M167A+P250G, R61P+M167A+P250G, Q246S+M167A+P250G, E245D+M167A+P250G, K291T+M167A+P250G, R61L+M167A+P250G, R61I+M167A+P250G, E245D+M167A+P250G+R61L, F169V+M167A+P250G+R61L, F165S+M167A+P250G+R61L, G59P+M167A+P250G+R61L, N312D+M167A+P250G+R61L, G59A+M167A+P250G+R61L, I94V+M167A+P250G+R61L, F165M+M167A+P250G+R61L,I94A+M167A+P250G+R61L, C96G+M167A+P250G+R61L, F169I+M167A+P250G+R61L, P58M+M167A+P250G+R61L, T216A+M167A+P250G+R61L, K291T+M167A+P250G+R61L, G59S+M167A+P250G+R61L, S293T+M167A+P250G+R61L, F169L+M167A+P250G+R61L, P58V+M167A+P250G+R61L, P58A+M167A+P250G+R61L, or C96A+M167A+P250G+R61L of the mature polypeptide of SEQ ID NO: 2.

Embodiment 27

The variant of any of embodiments 1-26, which comprises or consists of an amino acid sequence selected from any of SEQ ID NO: 5 to SEQ ID NO: 146, and SEQ ID NO: 147 to SEQ ID NO: 288.

Embodiment 28

The variant of any of embodiments 1-27, which has an improved organophosphorous hydrolase activity.

Embodiment 29

A composition comprising the variant of any of embodiments 1-28.

Embodiment 30

The composition of embodiment 29, wherein the composition is a micro emulsion or a lotion.

Embodiment 31

Use of a variant according to any of embodiments 1-28, or a composition of embodiment 29 or 30, for decontaminating an area or a device contaminated with at least one harmful or undesired organophosphorous compound; preferably, wherein the at least one harmful or undesired organophosphorous compound is selected among G-agents, V-agents and pesticides.

Embodiment 32

A method for removing an organophosphorous compound, comprising contacting the organophosphorous compound with the variant of any of embodiments 1-28, or the composition of embodiment 29 or 30.

Embodiment 33

A polynucleotide encoding the variant of any of embodiments 1-28.

Embodiment 34

A nucleic acid construct comprising the polynucleotide of embodiment 33.

Embodiment 35

An expression vector comprising the polynucleotide of embodiment 33.

Embodiment 36

A host cell comprising the polynucleotide of embodiment 33.

Embodiment 37

A method of producing an organophosphorous hydrolase variant, comprising: (a) cultivating the host cell of embodiment 36 under conditions suitable for expression of the variant; and (b) recovering the variant.

Embodiment 38

A transgenic plant, plant part or plant cell transformed with the polynucleotide of embodiment 33.

Embodiment 39

A method of producing a variant of any of embodiments 1-28, comprising: (a) cultivating a transgenic plant or a plant cell comprising a polynucleotide encoding the variant under conditions conducive for production of the variant; and (b) recovering the variant.

Embodiment 40

A method for obtaining an organophosphorous hydrolase variant, comprising introducing into a parent organophosphorous hydrolase a substitution at one or more positions corresponding to positions K34, D37, D38, P58, G59, R61, D63, D91, I94, C96, M111, E164, F165, K166, M167, F169, Q170, E171, R193, F194, T216, R219, D243, E245, Q246, E247, G248, P250, W266, D290, K291, S293, and N312; preferably positions P58, R61, F165, M167, R193, P250, and N312 of the mature polypeptide of SEQ ID NO: 2, wherein the variant has organophosphorous hydrolase activity; and recovering the variant.

The present invention is further described by the following examples that should not be construed as limiting the scope of the invention.

EXAMPLES

Chemicals used as buffers and substrates were commercial products of at least reagent grade.

Example 1

Cloning and Expression of Organophosphorous Hydrolase Variants
Cloning
A synthetic gene encoding the organophosphorous hydrolase from *Aplysia californica* (SEQ ID NO: 4) was previously prepared (see also WO 2010/128116). Furthermore, an N-terminal histidine-tagged gene of *Aplysia californica* was prepared for purification purposes by addition of 22 amino acids encoding a 6-histidine tag and an enterokinase cleavage site (SEQ ID NO: 2). Variants hereof were made by PCR-based site-directed mutagenesis with mutagenic primers that introduce the desired sequence change (substitutions). Primers were designed so that the mutation lies in the middle of the oligonucleotide with sufficient flanking nucleotides (14-25 basepairs). The PCR was setup with a proof-reading DNA polymerase (Phusion DNA polymerase (from Finnzymes, thermo Scientific) and the PCR products were integrated by homologous recombination into a Bacillus subtilis host cell genome. DNA was isolated from monoclonal transformed Bacillus subtilis strains and sequenced to verify the presence of the desired substitution. The gene constructs was expressed under the control of a triple promoter system (as described in WO 99/43835), consisting of the promoters from Bacillus licheniformis alpha-amylase gene (amyL), Bacillus amyloliquefaciens alpha-amylase gene (amyQ), and the Bacillus thuringiensis crylIIA promoter including the mRNA stabilizing sequence. The gene coding for Chloramphenicol acetyl-transferase was used as marker.

Expression

Chloramphenicol resistant Bacillus subtilis transformants harboring the His-tagged organophosphorous hydrolase genes described above were inoculated into 0.8 ml growth medium in 24-deep well plates. Cultures were grown for 3 days at 30° C. and 220 rpm.

Purification

Cells were harvested from the cultures by centrifugation at 4000 rpm for 10 min and supernatants collected for His-tag purification in 96-well plates according to instructions from the manufacture (GE Healthcare). Samples were then desalted using PD 96-well Trap G-25 plates according to instructions from the manufacture (GE Healthcare) and eluted in 50 mM Tris pH 7.0 with 1 mM $CaCl_2$. Yield of protein were measured at A280 and purity assessed by SDS-PAGE analysis.

Example 2

Measurement of Organophosphorous Hydrolase Activity

The organophosphorous hydrolase variants was used to hydrolyze the nerve agent VX (O-ethyl S-[2-(diisopropylamino)ethyl] methylphosphonothioate). Hydrolysis of VX was determined in a colorimetric assay based on the detection of free thiols with DTNB (5,5'-dithiobis-2-nitrobenzoate), as described in Broomfield et al., "Kinetics of nerve agent hydrolysis by a human plasma enzyme", CBMTS III Conference Proceedings, 7-12 May 2000, Spiez, Switzerland.

In the DTNB assay, the hydrolysis of VX, catalyzed by the organophosphorous hydrolase variants, was measured as the accumulation of 5-thio,2-nitro bisbenzoate at 412 nm. The assay was performed in 200 µl at pH 7.0, containing 50 mM TRIS buffer, 2 mM $CaCl_2$, 0.2 mM DTNB and 3.4 mM VX and 10 µg organophosphorous hydrolase variant enzyme, or no enzyme (autohydrolysis). The activity of each enzyme variant was calculated as the slope of absorbance at 412 nm (A412) over 30 minutes. The autohydrolysis was subtracted. The organophosphorous hydrolase activity of all variants is shown relative to the activity of the wildtype enzyme, as improvement factors, in Table 1. For example, an improvement factor of two means that the activity is two times higher than the wildtype enzyme.

TABLE 1

Hydrolysis of VX. VX hydrolysis is measured as the accumulation of 5-thio, 2-nitro bisbenzoate at 412 nm. 10 µg of enzyme was used in each assay. The improvement factors are calculated from the average activity measurement of three independent replicates for each variant.

| Variant (Substitution in SEQ ID NO: 2) | SEQ ID NO: | Improvement factor of Variant compared to Wildtype | Corresponding substitution in SEQ ID NO: 4 | SEQ ID NO: |
|---|---|---|---|---|
| Wildtype | 2 | 1.0 | — | — |
| F169I | 5 | 1.05 | F147I | 147 |
| W266F | 6 | 1.1 | W244F | 148 |
| C96A | 7 | 1.1 | C74A | 149 |
| E171Q | 8 | 1.1 | E149Q | 150 |
| Q246S | 9 | 1.1 | Q224S | 151 |
| R193Q | 10 | 1.1 | R171Q | 152 |
| K291T | 11 | 1.1 | K269T | 153 |
| F169Y | 12 | 1.1 | F147Y | 154 |
| F169W | 13 | 1.1 | F147W | 155 |
| T216A | 14 | 1.1 | T194A | 156 |
| G248V | 15 | 1.1 | G226V | 157 |
| P58G | 16 | 1.1 | P36G | 158 |
| M111A | 17 | 1.1 | M89A | 159 |
| G248A | 18 | 1.1 | G226A | 160 |
| I94V | 19 | 1.1 | I72V | 161 |
| I94A | 20 | 1.1 | I72A | 162 |
| C96G | 21 | 1.2 | C74G | 163 |
| I94G | 22 | 1.2 | I72G | 164 |
| G59P | 23 | 1.2 | G37P | 165 |
| G59T | 24 | 1.4 | G37T | 166 |
| F194A | 25 | 1.4 | F172A | 167 |
| P58V | 26 | 1.5 | P36V | 168 |
| F165G | 27 | 1.5 | F143G | 169 |
| M167I | 28 | 1.6 | M145I | 170 |
| G59S | 29 | 1.6 | G37S | 171 |
| M111G | 30 | 1.6 | M89G | 172 |
| P250G | 31 | 1.7 | P228G | 173 |
| P58M | 32 | 1.7 | P36M | 174 |

TABLE 1-continued

Hydrolysis of VX. VX hydrolysis is measured as the accumulation of 5-thio, 2-nitro bisbenzoate at 412 nm. 10 μg of enzyme was used in each assay. The improvement factors are calculated from the average activity measurement of three independent replicates for each variant.

| Variant (Substitution in SEQ ID NO: 2) | SEQ ID NO: | Improvement factor of Variant compared to Wildtype | Corresponding substitution in SEQ ID NO: 4 | SEQ ID NO: |
|---|---|---|---|---|
| T216M | 33 | 1.8 | T194M | 175 |
| F165L | 34 | 1.9 | F143L | 176 |
| P250A | 35 | 2.1 | P228A | 177 |
| E247W | 36 | 2.1 | E225W | 178 |
| F165M | 37 | 2.2 | F143M | 179 |
| N312D | 38 | 2.2 | N290D | 180 |
| P58S | 39 | 2.2 | P36S | 181 |
| T216V | 40 | 2.3 | T194V | 182 |
| M167V | 41 | 2.4 | M145V | 183 |
| P58A | 42 | 2.7 | P36A | 184 |
| F194W | 43 | 2.8 | F172W | 185 |
| M167S | 44 | 3.1 | M145S | 186 |
| R61L | 45 | 3.3 | R39L | 187 |
| R61P | 46 | 3.9 | R39P | 188 |
| R61N | 47 | 4.2 | R39N | 189 |
| I94F | 48 | 4.2 | I72F | 190 |
| R61I | 49 | 4.6 | R39I | 191 |
| F165I | 50 | 4.9 | F143I | 192 |
| R61V | 51 | 5.3 | R39V | 193 |
| F165A | 52 | 6.2 | F143A | 194 |
| F165V | 53 | 6.7 | F143V | 195 |
| F165S | 54 | 7.3 | F143S | 196 |
| M167G | 55 | 10.2 | M145G | 197 |
| M167A | 56 | 13.9 | M145A | 198 |
| D38A + M167A | 57 | 4.3 | D16A + M145A | 199 |
| P250I + M167A | 58 | 4.7 | P228I + M145A | 200 |
| E247A + M167A | 59 | 6.4 | E225A + M145A | 201 |
| P250M + M167A | 60 | 6.8 | P228M + M145A | 202 |
| D91N + M167A | 61 | 7.5 | D69N + M145A | 203 |
| R219S + M167A | 62 | 7.9 | R197S + M145A | 204 |
| D37N + M167A | 63 | 8.0 | D15N + M145A | 205 |
| K34A + M167A | 64 | 8.3 | K12A + M145A | 206 |
| E164P + M167A | 65 | 8.9 | E142P + M145A | 207 |
| R219A + M167A | 66 | 9.4 | R197A + M145A | 208 |
| R61L + M167A | 67 | 9.4 | R39L + M145A | 209 |
| F165A + M167A | 68 | 9.9 | F143A + M145A | 210 |
| D91S + M167A | 69 | 11.1 | D69S + M145A | 211 |
| D37T + M167A | 70 | 11.6 | D15T + M145A | 212 |
| R219T + M167A | 71 | 11.6 | R197T + M145A | 213 |
| K166S + M167A | 72 | 11.7 | K144S + M145A | 214 |
| Q170E + M167A | 73 | 11.9 | Q148E + M145A | 215 |
| D37S + M167A | 74 | 12.1 | D15S + M145A | 216 |
| K166T + M167A | 75 | 12.4 | K144T + M145A | 217 |
| D63N + M167A | 76 | 12.4 | D41N + M145A | 218 |
| F165S + M167A | 77 | 12.4 | F143S + M145A | 219 |
| D91T + M167A | 78 | 12.7 | D69T + M145A | 220 |
| K291A + M167A | 79 | 12.7 | K269A + M145A | 221 |
| Q246A + M167A | 80 | 13.0 | Q224A + M145A | 222 |
| E247Q + M167A | 81 | 13.1 | E225Q + M145A | 223 |
| D37A + M167A | 82 | 13.3 | D15A + M145A | 224 |
| Q246T + M167A | 83 | 13.3 | Q224T + M145A | 225 |
| D38E + M167A | 84 | 13.4 | D16E + M145A | 226 |
| D38N + M167A | 85 | 13.5 | D16N + M145A | 227 |
| E247D + M167A | 86 | 13.8 | E225D + M145A | 228 |
| E171Q + M167A | 87 | 14.3 | E149Q + M145A | 229 |
| K291T + M167A | 88 | 14.6 | K269T + M145A | 230 |
| D243A + M167A | 89 | 14.6 | D221A + M145A | 231 |
| D290N + M167A | 90 | 14.9 | D268N + M145A | 232 |
| D290Q + M167A | 91 | 15.0 | D268Q + M145A | 233 |
| Q246S + M167A | 92 | 15.1 | Q224S + M145A | 234 |
| R219K + M167A | 93 | 15.4 | R197K + M145A | 235 |
| D63R + M167A | 94 | 16.0 | D41R + M145A | 236 |
| D290A + M167A | 95 | 16.1 | D268A + M145A | 237 |
| D63E + M167A | 96 | 16.2 | D41E + M145A | 238 |
| R193N + M167A | 97 | 16.2 | R171N + M145A | 239 |
| E245D + M167A | 98 | 16.5 | E223D + M145A | 240 |
| D290E + M167A | 99 | 16.6 | D268E + M145A | 241 |
| E164A + M167A | 100 | 16.7 | E142A + M145A | 242 |
| D243Q + M167A | 101 | 16.8 | D221Q + M145A | 243 |

TABLE 1-continued

Hydrolysis of VX. VX hydrolysis is measured as the accumulation of 5-thio, 2-nitro bisbenzoate at 412 nm. 10 μg of enzyme was used in each assay. The improvement factors are calculated from the average activity measurement of three independent replicates for each variant.

| Variant (Substitution in SEQ ID NO: 2) | SEQ ID NO: | Improvement factor of Variant compared to Wildtype | Corresponding substitution in SEQ ID NO: 4 | SEQ ID NO: |
|---|---|---|---|---|
| D243G + M167A | 102 | 17.0 | D221G + M145A | 244 |
| D243N + M167A | 103 | 17.2 | D221N + M145A | 245 |
| E245Q + M167A | 104 | 17.2 | E223Q + M145A | 246 |
| Q170D + M167A | 105 | 17.5 | Q148D + M145A | 247 |
| E171A + M167A | 106 | 17.6 | E149A + M145A | 248 |
| Q170N + M167A | 107 | 17.6 | Q148N + M145A | 249 |
| P250A + M167A | 108 | 17.9 | P228A + M145A | 250 |
| P250G + M167A | 109 | 20.9 | P228G + M145A | 251 |
| R193Q + M167A | 110 | 20.9 | R171Q + M145A | 252 |
| N312D + M167A | 111 | 21.3 | N290D + M145A | 253 |
| R61V + M167A + P250G | 112 | 7.3 | R39V + M145A + P228G | 254 |
| W266F + M167A + P250G | 113 | 7.4 | W244F + M145A + P228G | 255 |
| R61L + N312D + M167A | 114 | 10.7 | R39L + N290D + M145A | 256 |
| I94F + M167A + P250G | 115 | 11.8 | I72F + M145A + P228G | 257 |
| N312D + M167A + P250G | 116 | 12.1 | N290D + M145A + P228G | 258 |
| R61N + M167A + P250G | 117 | 13.0 | R39N + M145A + P228G | 259 |
| R193Q + M167A + P250G | 118 | 13.2 | R171Q + M145A + P228G | 260 |
| E171Q + M167A + P250G | 119 | 16.5 | E149Q + M145A + P228G | 261 |
| F165V + M167A + P250G | 120 | 16.6 | F143V + M145A + P228G | 262 |
| R61P + M167A + P250G | 121 | 16.6 | R39P + M145A + P228G | 263 |
| Q246S + M167A + P250G | 122 | 16.8 | Q224S + M145A + P228G | 264 |
| E245D + M167A + P250G | 123 | 16.8 | E223D + M145A + P228G | 265 |
| K291T + M167A + P250G | 124 | 16.8 | K269T + M145A + P228G | 266 |
| R61L + M167A + P250G | 125 | 17.6 | R39L + M145A + P228G | 267 |
| R61I + M167A + P250G | 126 | 19.0 | R39I + M145A + P228G | 268 |
| E245D + M167A + P250G + R61L | 127 | 3.0 | E223D + M145A + P228G + R39L | 269 |
| F169V + M167A + P250G + R61L | 128 | 7.7 | F147V + M145A + P228G + R39L | 270 |
| F165S + M167A + P250G + R61L | 129 | 7.7 | F143S + M145A + P228G + R39L | 271 |
| G59P + M167A + P250G + R61L | 130 | 8.1 | G37P + M145A + P228G + R39L | 272 |
| N312D + M167A + P250G + R61L | 131 | 8.3 | N290D + M145A + P228G + R39L | 273 |
| G59A + M167A + P250G + R61L | 132 | 8.5 | G37A + M145A + P228G + R39L | 274 |
| I94V + M167A + P250G + R61L | 133 | 11.0 | I72V + M145A + P228G + R39L | 275 |
| F165M + M167A + P250G + R61L | 134 | 11.5 | F143M + M145A + P228G + R39L | 276 |
| I94A + M167A + P250G + R61L | 135 | 11.6 | I72A + M145A + P228G + R39L | 277 |
| C96G + M167A + P250G + R61L | 136 | 11.8 | C74G + M145A + P228G + R39L | 278 |
| F169I + M167A + P250G + R61L | 137 | 12.1 | F147I + M145A + P228G + R39L | 279 |
| P58M + M167A + P250G + R61L | 138 | 12.3 | P36M + M145A + P228G + R39L | 280 |
| T216A + M167A + P250G + R61L | 139 | 12.7 | T194A + M145A + P228G + R39L | 281 |
| K291T + M167A + P250G + R61L | 140 | 12.7 | K269T + M145A + P228G + R39L | 282 |
| G59S + M167A + P250G + R61L | 141 | 12.9 | G37S + M145A + P228G + R39L | 283 |
| S293T + M167A + P250G + R61L | 142 | 13.2 | S271T + M145A + P228G + R39L | 284 |
| F169L + M167A + P250G + R61L | 143 | 16.5 | F147L + M145A + P228G + R39L | 285 |
| P58V + M167A + P250G + R61L | 144 | 18.2 | P36V + M145A + P228G + R39L | 286 |
| P58A + M167A + P250G + R61L | 145 | 19.2 | P36A + M145A + P228G + R39L | 287 |
| C96A + M167A + P250G + R61L | 146 | 19.8 | C74A + M145A + P228G + R39L | 288 |

Example 3

Effect of Histidine-Tag on Organophosphorous Hydrolase Activity

To examine the effect of the added histidine-tag, the variant M167A with and without a histidine-tag was examined in the DTNB assay. In the DTNB assay, VX hydrolysis results in accumulation of 5-thio,2-nitro bisbenzoate, which can be measured at 412 nm (see Example 2). 10 μg of enzyme was used in each assay. The improvement factors were calculated from the average activity measurement of three independent replicates for each variant, and the results are shown in Table 2.

As Table 2 indicates, the variant with and without histidine-tag showed similar activities. Therefore, it can be concluded that the histidine-tag does not affect the activity of the organophosphorous hydrolase.

TABLE 2

Improvement factors from hydrolysis of VX.

| Variant | Improvement factor |
|---|---|
| M167A with his-tag | 1.0 |
| M167A without his-tag | 1.6 |

The invention described and claimed herein is not to be limited in scope by the specific aspects herein disclosed, since these aspects are intended as illustrations of several aspects of the invention. Any equivalent aspects are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

SEQUENCE LISTING (288 sequences)

SEQ ID NO: 1 - DNA, 996 bp, Aplysia californica
  CDS (1)..(993)
atggcacatcaccaccaccatcacgtgggtaccggttcgaatgatgacgacgacaagagtccggatcccgcacctacggttgtatctcttcagtttagcaaaatcatcgacgacgtttcaggcgctgaaggccctgtattcgacagcaacggtactttctacgttgtagctcctggtgtacgcaaagacgctaaacctgctggccaagttgtacgcatcgacctttcatcaggtcagaaaacagttctttgcgagcctcaagtaaacggtgacggaggcatcccttgcggctgccaagctgacaaacaaggcaacctttacgttgctgacatgcgccttggtatccttaaagtaaaaccaaacggcgagttcactcaagttgctcgcgtagacgaaggtggtcgcacaatgcaaggctgcaacgactgctctcttgactatacaggcaacctttgggtaactgcgcctgctggcgacatcgctccttctgagttcaaaatgtcttttcaggagtctatcggttcaatctattgccttacatctgagggtaaagtagtacatcttgacactggtcttcgcttccctaacggcatcgctgttatccatgacgctaatcgtcgccctgttaaacttatcgtagcggagacacctacacgccttcttcttgcttacgacatccaaggccctggtcttgtagcgaacaaaactaaatgggctaaacttcctgactgcgagcaagaaggtggccctgacggtatggacttcgacgacgcaggtaaccttcttgttgctcactggggtgctggtcatatcgaggtttttggtcctgatggcggtgagcctatcaaacgcatcaaatgtccatttgacaaacctagcaacgtacacttcgagcctaactctaacatcgtttacgtaactgagcatacgaacaacgctctttggaaattccaatgggagaacaaaggcatgcctcagtattgtgacaaaaactaa

SEQ ID NO: 2 - protein, 331 aa, Aplysia californica [sequence omitted]

SEQ ID NO: 3 - DNA, 930 bp, Aplysia californica
  CDS (1)..(927)
atggctcccacagtcgtctctctacagttttcaaaaattattgacgatgtatcaggagcagaaggcccagtgtttgacagtaacggcactttttatgttgttgctcctggagtaagaaaagatgcaaagccggctggtcaggtcgtccgaattgacctgagctcaggacagaaaactgttttgtgtgagcctcaggttaacggtgatgggggaattccgtgtggttgccaagctgacaagcagggcaacttatatgtcgctgacatgaggctgggaatcttgaaagtcaaacctaatggagaattcacgcaggtggcaagagtagacgagggaggaaggaccatgcagggctgtaatgactgtagcctcgactataccgggaacctgtgggtcacggcaccagctggtgacatagccccgagtgaattcaagatgtcgtttcaggaaagtattggttcgatttactgcttgacttcagagggaaaagtggttcatttggacacagggctcagattcccaaacggtatagctgtcattcatgacgcaaacaggcggccggtaaagctcatagtggcagaaacgccgacgcgactcctcttggcctatgacattcaaggacctggattagtcgctaataaaacgaaatgggccaaattgccagattgtgagcaagaaggtggcccagatggaatggactttgacgatgcgggaaatttgctggtggctcactggggtgccgggcacatcgaagtgtttggtccggacggaggcgaaccgatcaagcgtatcaagtgtccttttgacaagccgagcaatgtgcattttgagccaaactccaacatcgtgtacgtgacggagcacacgaacaacgccctatggaagttccagtgggagaacaagggcatgcctcagtattgtgacaaaaactga

SEQ ID NO: 4 - protein, 309 aa, Aplysia californica
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 5 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSIQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 6 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHFGAGHIEVFGPDGGEPIKRIKCPFDKPSNVHFEPNSNIVYVTEHTNNALWKFQWENKGMPQYCDKN

SEQ ID NO: 7 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPAGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 8 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQQSIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 9 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCESEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 10 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLQFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 11 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDTPSNVHFEPNSNIVYVTEHTNNALWKFQWENKGMPQYCDKN

SEQ ID NO: 12 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSYQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 13 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSWQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 14 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAEAPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 15 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEVGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 16 - protein, 331 aa, Artificial
  Synthetic variant
MAHHHHHHVGTGSNDDDDKSPDPAPTVVSLQFSKIIDDVSGAEGPVFDSNGTFYVVAGGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 17 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADARLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 18 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEAGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 19 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGVPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 20 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGAPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 21 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPGGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 22 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGGPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 23 - protein, 331 aa, Artificial
  Synthetic variant
MAHHHHHHVGTGSNDDDDKSPDPAPTVVSLQFSKIIDDVSGAEGPVFDSNGTFYVVAPPVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 24 - protein, 331 aa, Artificial
  Synthetic variant
MAHHHHHHVGTGSNDDDDKSPDPAPTVVSLQFSKIIDDVSGAEGPVFDSNGTFYVVAPTVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 25 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRAPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 26 - protein, 331 aa, Artificial
  Synthetic variant
MAHHHHHHVGTGSNDDDDKSPDPAPTVVSLQFSKIIDDVSGAEGPVFDSNGTFYVVAVGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 27 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEGKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 28 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKISFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 29 - protein, 331 aa, Artificial
  Synthetic variant
MAHHHHHHVGTGSNDDDDKSPDPAPTVVSLQFSKIIDDVSGAEGPVFDSNGTFYVVAPSVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 30 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADGRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 31 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 32 - protein, 331 aa, Artificial
  Synthetic variant
MAHHHHHHVGTGSNDDDDKSPDPAPTVVSLQFSKIIDDVSGAEGPVFDSNGTFYVVAMGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 33 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAEMPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 34 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSELKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 35 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGADGMDFDDAGNLLVAHWGAGHIEVFGPDGGEPIKRIKCPFDKPSNVHFEPNSNIVYVTEHTNNALWKFQWENKGMPQYCDKN

SEQ ID NO: 36 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQWGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 37 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEMKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 38 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 39 - protein, 331 aa, Artificial
  Synthetic variant
MAHHHHHHVGTGSNDDDDKSPDPAPTVVSLQFSKIIDDVSGAEGPVFDSNGTFYVVASGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 40 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAEVPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 41 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKVSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 42 - protein, 331 aa, Artificial
  Synthetic variant
MAHHHHHHVGTGSNDDDDKSPDPAPTVVSLQFSKIIDDVSGAEGPVFDSNGTFYVVAAGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 43 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRWPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 44 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKSSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 45 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 46 - protein, 331 aa, Artificial
  Synthetic variant
MAHHHHHHVGTGSNDDDDKSPDPAPTVVSLQFSKIIDDVSGAEGPVFDSNGTFYVVAPGVPKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 47 - protein, 331 aa, Artificial
  Synthetic variant
MAHHHHHHVGTGSNDDDDKSPDPAPTVVSLQFSKIIDDVSGAEGPVFDSNGTFYVVAPGVNKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 48 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGFPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 49 - protein, 331 aa, Artificial
  Synthetic variant
MAHHHHHHVGTGSNDDDDKSPDPAPTVVSLQFSKIIDDVSGAEGPVFDSNGTFYVVAPGVIKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 50 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEIKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 51 - protein, 331 aa, Artificial
  Synthetic variant
MAHHHHHHVGTGSNDDDDKSPDPAPTVVSLQFSKIIDDVSGAEGPVFDSNGTFYVVAPGVVKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 52 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEAKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 53 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEVKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 54 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSESKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 55 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKGSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 56 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 57 - protein, 331 aa, Artificial
  Synthetic variant
MAHHHHHHVGTGSNDDDDKSPDPAPTVVSLQFSKIIDAVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 58 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGIDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 59 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQAGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 60 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGMDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 61 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGNGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 62 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTSLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 63 - protein, 331 aa, Artificial
  Synthetic variant
MAHHHHHHVGTGSNDDDDKSPDPAPTVVSLQFSKIINDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 64 - protein, 331 aa, Artificial
  Synthetic variant
MAHHHHHHVGTGSNDDDDKSPDPAPTVVSLQFSAIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 65 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSPFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 66 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTALLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 67 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 68 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEAKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 69 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGSGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 70 - protein, 331 aa, Artificial
  Synthetic variant
MAHHHHHHVGTGSNDDDDKSPDPAPTVVSLQFSKIITDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 71 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTTLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 72 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFSASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 73 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFEESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 74 - protein, 331 aa, Artificial
  Synthetic variant
MAHHHHHHVGTGSNDDDDKSPDPAPTVVSLQFSKIISDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 75 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFTASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 76 - protein, 331 aa, Artificial
  Synthetic variant
MAHHHHHHVGTGSNDDDDKSPDPAPTVVSLQFSKIIDDVSGAEGPVFDSNGTFYVVAPGVRKNAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 77 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSESKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 78 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGTGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 79 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDAPSNVHFEPNSNIVYVTEHTNNALWKFQWENKGMPQYCDKN

SEQ ID NO: 80 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEAEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 81 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQQGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 82 - protein, 331 aa, Artificial
  Synthetic variant
MAHHHHHHVGTGSNDDDDKSPDPAPTVVSLQFSKIIADVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 83 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCETEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 84 - protein, 331 aa, Artificial
  Synthetic variant
MAHHHHHHVGTGSNDDDDKSPDPAPTVVSLQFSKIIDEVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 85 - protein, 331 aa, Artificial
  Synthetic variant
MAHHHHHHVGTGSNDDDDKSPDPAPTVVSLQFSKIIDNVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 86 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQDGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 87 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQQSIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 88 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDTPSNVHFEPNSNIVYVTEHTNNALWKFQWENKGMPQYCDKN

SEQ ID NO: 89 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPACEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 90 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFNKPSNVHFEPNSNIVYVTEHTNNALWKFQWENKGMPQYCDKN

SEQ ID NO: 91 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFQKPSNVHFEPNSNIVYVTEHTNNALWKFQWENKGMPQYCDKN

SEQ ID NO: 92 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCESEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 93 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTKLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 94 - protein, 331 aa, Artificial
  Synthetic variant
MAHHHHHHVGTGSNDDDDKSPDPAPTVVSLQFSKIIDDVSGAEGPVFDSNGTFYVVAPGVRKRAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 95 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFAKPSNVHFEPNSNIVYVTEHTNNALWKFQWENKGMPQYCDKN

SEQ ID NO: 96 - protein, 331 aa, Artificial
  Synthetic variant
MAHHHHHHVGTGSNDDDDKSPDPAPTVVSLQFSKIIDDVSGAEGPVFDSNGTFYVVAPGVRKEAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 97 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLNFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 98 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCDQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 99 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFEKPSNVHFEPNSNIVYVTEHTNNALWKFQWENKGMPQYCDKN

SEQ ID NO: 100 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSAFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 101 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPQCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 102 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPGCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 103 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPNCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 104 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCQQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 105 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFDESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 106 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQASIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 107 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFNESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 108 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGADGMDFDDAGNLLVAHWGAGHIEVFGPDGGEPIKRIKCPFDKPSNVHFEPNSNIVYVTEHTNNALWKFQWENKGMPQYCDKN

SEQ ID NO: 109 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 110 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLQFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 111 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 112 - protein, 331 aa, Artificial
  Synthetic variant
MAHHHHHHVGTGSNDDDDKSPDPAPTVVSLQFSKIIDDVSGAEGPVFDSNGTFYVVAPGVVKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 113 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHFGAGHIEVFGPDGGEPIKRIKCPFDKPSNVHFEPNSNIVYVTEHTNNALWKFQWENKGMPQYCDKN

SEQ ID NO: 114 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 115 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGFPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 116 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 117 - protein, 331 aa, Artificial
  Synthetic variant
MAHHHHHHVGTGSNDDDDKSPDPAPTVVSLQFSKIIDDVSGAEGPVFDSNGTFYVVAPGVNKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 118 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLQFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 119 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQQSIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 120 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEVKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 121 - protein, 331 aa, Artificial
  Synthetic variant
MAHHHHHHVGTGSNDDDDKSPDPAPTVVSLQFSKIIDDVSGAEGPVFDSNGTFYVVAPGVPKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 122 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCESEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 123 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCDQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 124 - protein, 331 aa, Artificial
  Synthetic variant
MAHHHHHHVGTGSNDDDDKSPDPAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDTPSNVHFEPNSNIVYVTEHTNNALWKFQWENKGMPQYCDKN

SEQ ID NO: 125 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 126 - protein, 331 aa, Artificial
  Synthetic variant
MAHHHHHHVGTGSNDDDDKSPDPAPTVVSLQFSKIIDDVSGAEGPVFDSNGTFYVVAPGVIKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 127 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCDQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 128 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASVQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 129 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSESKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 130 - protein, 331 aa, Artificial
  Synthetic variant
MAHHHHHHVGTGSNDDDDKSPDPAPTVVSLQFSKIIDDVSGAEGPVFDSNGTFYVVAPPVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 131 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 132 - protein, 331 aa, Artificial
  Synthetic variant
MAHHHHHHVGTGSNDDDDKSPDPAPTVVSLQFSKIIDDVSGAEGPVFDSNGTFYVVAPAVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 133 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGVPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 134 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEMKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 135 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGAPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 136 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPGGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 137 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASIQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 138 - protein, 331 aa, Artificial
  Synthetic variant
MAHHHHHHVGTGSNDDDDKSPDPAPTVVSLQFSKIIDDVSGAEGPVFDSNGTFYVVAMGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 139 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAEAPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 140 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDTPSNVHFEPNSNIVYVTEHTNNALWKFQWENKGMPQYCDKN

SEQ ID NO: 141 - protein, 331 aa, Artificial
  Synthetic variant
MAHHHHHHVGTGSNDDDDKSPDPAPTVVSLQFSKIIDDVSGAEGPVFDSNGTFYVVAPSVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 142 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPTNVHFEPNSNIVYVTEHTNNALWKFQWENKGMPQYCDKN

SEQ ID NO: 143 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASLQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 144 - protein, 331 aa, Artificial
  Synthetic variant
MAHHHHHHVGTGSNDDDDKSPDPAPTVVSLQFSKIIDDVSGAEGPVFDSNGTFYVVAVGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 145 - protein, 331 aa, Artificial
  Synthetic variant
MAHHHHHHVGTGSNDDDDKSPDPAPTVVSLQFSKIIDDVSGAEGPVFDSNGTFYVVAAGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 146 - protein, 331 aa, Artificial
  Synthetic variant
MAHHHHHHVGTGSNDDDDKSPDPAPTVVSLQFSKIIDDVSGAEGPVFDSNGTFYVVAPGVLKDAKPAGQVVRIDLSSGQKTVLCEPQVNGDGGIPAGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 147 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSIQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 148 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHFGAGHIEVFGPDGGEPIKRIKCPFDKPSNVHFEPNSNIVYVTEHTNNALWKFQWENKGMPQYCDKN

SEQ ID NO: 149 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPAGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 150 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQQSIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 151 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCESEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 152 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLQFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 153 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDTPSNVHFEPNSNIVYVTEHTNNALWKFQWENKGMPQYCDKN

SEQ ID NO: 154 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSYQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 155 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSWQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 156 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAEAPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 157 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEVGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 158 - protein, 309 aa, Artificial
  Synthetic variant
MAPTVVSLQFSKIIDDVSGAEGPVFDSNGTFYVVAGGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 159 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADARLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 160 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEAGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 161 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGVPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 162 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGAPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 163 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPGGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 164 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGGPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 165 - protein, 309 aa, Artificial
  Synthetic variant
MAPTVVSLQFSKIIDDVSGAEGPVFDSNGTFYVVAPPVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 166 - protein, 309 aa, Artificial
  Synthetic variant
MAPTVVSLQFSKIIDDVSGAEGPVFDSNGTFYVVAPTVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 167 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRAPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 168 - protein, 309 aa, Artificial
  Synthetic variant
MAPTVVSLQFSKIIDDVSGAEGPVFDSNGTFYVVAVGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 169 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEGKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 170 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKISFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 171 - protein, 309 aa, Artificial
  Synthetic variant
MAPTVVSLQFSKIIDDVSGAEGPVFDSNGTFYVVAPSVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 172 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADGRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 173 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 174 - protein, 309 aa, Artificial
  Synthetic variant
MAPTVVSLQFSKIIDDVSGAEGPVFDSNGTFYVVAMGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 175 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAEMPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 176 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSELKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 177 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGADGMDFDDAGNLLVAHWGAGHIEVFGPDGGEPIKRIKCPFDKPSNVHFEPNSNIVYVTEHTNNALWKFQWENKGMPQYCDKN

SEQ ID NO: 178 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQWGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 179 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEMKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 180 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 181 - protein, 309 aa, Artificial
  Synthetic variant
MAPTVVSLQFSKIIDDVSGAEGPVFDSNGTFYVVASGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 182 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAEVPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 183 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKVSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 184 - protein, 309 aa, Artificial
  Synthetic variant
MAPTVVSLQFSKIIDDVSGAEGPVFDSNGTFYVVAAGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 185 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRWPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 186 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKSSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 187 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 188 - protein, 309 aa, Artificial
  Synthetic variant
MAPTVVSLQFSKIIDDVSGAEGPVFDSNGTFYVVAPGVPKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 189 - protein, 309 aa, Artificial
  Synthetic variant
MAPTVVSLQFSKIIDDVSGAEGPVFDSNGTFYVVAPGVNKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 190 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGFPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 191 - protein, 309 aa, Artificial
  Synthetic variant
MAPTVVSLQFSKIIDDVSGAEGPVFDSNGTFYVVAPGVIKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 192 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEIKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 193 - protein, 309 aa, Artificial
  Synthetic variant
MAPTVVSLQFSKIIDDVSGAEGPVFDSNGTFYVVAPGVVKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 194 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEAKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 195 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEVKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 196 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSESKMSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 197 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKGSFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 198 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 199 - protein, 309 aa, Artificial
  Synthetic variant
MAPTVVSLQFSKIIDAVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 200 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGIDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 201 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQAGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 202 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGMDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 203 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGNGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 204 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTSLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 205 - protein, 309 aa, Artificial
  Synthetic variant
MAPTVVSLQFSKIINDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 206 - protein, 309 aa, Artificial
  Synthetic variant
MAPTVVSLQFSAIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 207 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSPFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 208 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTALLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 209 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 210 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEAKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 211 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGSGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 212 - protein, 309 aa, Artificial
  Synthetic variant
MAPTVVSLQFSKIITDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 213 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTTLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 214 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFSASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 215 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFEESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 216 - protein, 309 aa, Artificial
  Synthetic variant
MAPTVVSLQFSKIISDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 217 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFTASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 218 - protein, 309 aa, Artificial
  Synthetic variant
MAPTVVSLQFSKIIDDVSGAEGPVFDSNGTFYVVAPGVRKNAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 219 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSESKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 220 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGTGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 221 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDAPSNVHFEPNSNIVYVTEHTNNALWKFQWENKGMPQYCDKN

SEQ ID NO: 222 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEAEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 223 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQQGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 224 - protein, 309 aa, Artificial
  Synthetic variant
MAPTVVSLQFSKIIADVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 225 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCETEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 226 - protein, 309 aa, Artificial
  Synthetic variant
MAPTVVSLQFSKIIDEVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 227 - protein, 309 aa, Artificial
  Synthetic variant
MAPTVVSLQFSKIIDNVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 228 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQDGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 229 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQQSIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 230 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDTPSNVHFEPNSNIVYVTEHTNNALWKFQWENKGMPQYCDKN

SEQ ID NO: 231 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPACEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 232 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFNKPSNVHFEPNSNIVYVTEHTNNALWKFQWENKGMPQYCDKN

SEQ ID NO: 233 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFQKPSNVHFEPNSNIVYVTEHTNNALWKFQWENKGMPQYCDKN

SEQ ID NO: 234 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCESEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 235 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTKLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 236 - protein, 309 aa, Artificial
  Synthetic variant
MAPTVVSLQFSKIIDDVSGAEGPVFDSNGTFYVVAPGVRKRAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 237 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFAKPSNVHFEPNSNIVYVTEHTNNALWKFQWENKGMPQYCDKN

SEQ ID NO: 238 - protein, 309 aa, Artificial
  Synthetic variant
MAPTVVSLQFSKIIDDVSGAEGPVFDSNGTFYVVAPGVRKEAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 239 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLNFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 240 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCDQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 241 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFEKPSNVHFEPNSNIVYVTEHTNNALWKFQWENKGMPQYCDKN

SEQ ID NO: 242 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSAFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 243 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPQCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 244 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPGCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 245 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPNCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 246 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCQQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 247 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFDESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 248 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQASIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 249 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFNESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 250 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGADGMDFDDAGNLLVAHWGAGHIEVFGPDGGEPIKRIKCPFDKPSNVHFEPNSNIVYVTEHTNNALWKFQWENKGMPQYCDKN

SEQ ID NO: 251 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 252 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLQFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 253 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 254 - protein, 309 aa, Artificial
  Synthetic variant
MAPTVVSLQFSKIIDDVSGAEGPVFDSNGTFYVVAPGVVKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 255 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHFGAGHIEVFGPDGGEPIKRIKCPFDKPSNVHFEPNSNIVYVTEHTNNALWKFQWENKGMPQYCDKN

SEQ ID NO: 256 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGPDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 257 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGFPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 258 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 259 - protein, 309 aa, Artificial
  Synthetic variant
MAPTVVSLQFSKIIDDVSGAEGPVFDSNGTFYVVAPGVNKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 260 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLQFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 261 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQQSIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 262 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEVKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 263 - protein, 309 aa, Artificial
  Synthetic variant
MAPTVVSLQFSKIIDDVSGAEGPVFDSNGTFYVVAPGVPKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 264 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCESEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 265 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCDQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 266 - protein, 309 aa, Artificial
  Synthetic variant
MAPTVVSLQFSKIIDDVSGAEGPVFDSNGTFYVVAPGVRKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDTPSNVHFEPNSNIVYVTEHTNNALWKFQWENKGMPQYCDKN

SEQ ID NO: 267 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 268 - protein, 309 aa, Artificial
  Synthetic variant
MAPTVVSLQFSKIIDDVSGAEGPVFDSNGTFYVVAPGVIKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 269 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCDQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 270 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASVQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 271 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSESKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 272 - protein, 309 aa, Artificial
  Synthetic variant
MAPTVVSLQFSKIIDDVSGAEGPVFDSNGTFYVVAPPVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 273 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNDALWKFQWENKGMPQYCDKN

SEQ ID NO: 274 - protein, 309 aa, Artificial
  Synthetic variant
MAPTVVSLQFSKIIDDVSGAEGPVFDSNGTFYVVAPAVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 275 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGVPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 276 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEMKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 277 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGAPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 278 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPGGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 279 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASIQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 280 - protein, 309 aa, Artificial
  Synthetic variant
MAPTVVSLQFSKIIDDVSGAEGPVFDSNGTFYVVAMGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 281 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAEAPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 282 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDTPSNVHFEPNSNIVYVTEHTNNALWKFQWENKGMPQYCDKN

SEQ ID NO: 283 - protein, 309 aa, Artificial
  Synthetic variant
MAPTVVSLQFSKIIDDVSGAEGPVFDSNGTFYVVAPSVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 284 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPTNVHFEPNSNIVYVTEHTNNALWKFQWENKGMPQYCDKN

SEQ ID NO: 285 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASLQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 286 - protein, 309 aa, Artificial
  Synthetic variant
MAPTVVSLQFSKIIDDVSGAEGPVFDSNGTFYVVAVGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 287 - protein, 309 aa, Artificial
  Synthetic variant
MAPTVVSLQFSKIIDDVSGAEGPVFDSNGTFYVVAAGVLKDAKPAGQVVRIDLSSGQKTVLCEPQVNGDGGIPCGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

SEQ ID NO: 288 - protein, 309 aa, Artificial
  Synthetic variant
MAPTVVSLQFSKIIDDVSGAEGPVFDSNGTFYVVAPGVLKDAKPAGQVVRIDLSSGQKTVLCEPQVNGDGGIPAGCQADKQGNLYVADMRLGILKVKPNGEFTQVARVDEGGRTMQGCNDCSLDYTGNLWVTAPAGDIAPSEFKASFQESIGSIYCLTSEGKVVHLDTGLRFPNGIAVIHDANRRPVKLIVAETPTRLLLAYDIQGPGLVANKTKWAKLPDCEQEGGGDGMDFDDAGNLLVAHWGAGHIEVFGPDGGEPIKRIKCPFDKPSNVHFEPNSNIVYVTEHTNNALWKFQWENKGMPQYCDKN

The invention claimed is:

1. An organophosphorous hydrolase variant, comprising a substitution at one or more positions corresponding to positions K34, D37, D38, P58, G59, R61, D63, D91, I94, C96, M111, E164, F165, K166, M167, F169, Q170, E171, R193, F194, T216, R219, D243, E245, Q246, E247, G248, P250, W266, D290, K291, S293, and N312; wherein the variant has organophosphorous hydrolase activity and wherein the variant has at least 90% but less than 100% sequence identity to the mature polypeptide of SEQ ID NO: 2.

2. The variant of claim 1, which comprises a substitution at a position corresponding to position P58 with Ala, Gly, Met, Ser, or Val.

3. The variant of claim 1, which comprises a substitution at a position corresponding to position R61 with Ile, Leu, Asn, Pro, or Val.

4. The variant of claim 1, which comprises a substitution at a position corresponding to position F165 with Ala, Gly, Ile, Leu, Met, Ser, or Val.

5. The variant of claim 1, which comprises a substitution at a position corresponding to position M167 with Ala, Gly, Ile, Ser, or Val.

6. The variant of claim 1, which comprises a substitution at a position corresponding to position R193 with Asn or Gln.

7. The variant of claim 1, which comprises a substitution at a position corresponding to position P250 with Ala, Gly, Ile, or Met.

8. The variant of claim 1, which comprises a substitution at a position corresponding to position N312 with Asp.

9. The variant of claim 1, which comprises one or more substitutions corresponding to substitutions selected from the group consisting of K34A, D37A, D37N, D37S, D37T, D38A, D38E, D38N, P58A, P58G, P58M, P58S, P58V, G59A, G59P, G59S, G59T, R61I, R61L, R61N, R61P, R61V, D63E, D63N, D63R, D91N, D91S, D91T, I94A, I94F, I94G, I94V, C96A, C96G, M111A, M111G, E164A, E164P, F165A, F165G, F165I, F165L, F165M, F165S, F165V, K166S, K166T, M167A, M167G, M167I, M167S, M167V, F169I, F169L, F169V, F169W, F169Y, Q170D, Q170E, Q170N, E171A, E171Q, R193N, R193Q, F194A, F194W, T216A, T216M, T216V, R219A, R219K, R219S, R219T, D243A, D243G, D243N, D243Q, E245D, E245Q, Q246A, Q246S, Q246T, E247A, E247D, E247Q, E247W, G248A, G248V, P250A, P250G, P250I, P250M, W266F, D290A, D290E, D290N, D290Q, K291A, K291T, S293T, and N312D.

10. The variant of claim 1, comprising a substitution corresponding to F169I, W266F, C96A, E171Q, Q246S, R193Q, K291T, F169Y, F169W, T216A, G248V, P58G, M111A, G248A, I94V, I94A, C96G, I94G, G59P, G59T, F194A, P58V, F165G, M167I, G59S, M111G, P250G, P58M, T216M, F165L, P250A, E247W, F165M, N312D, P58S, T216V, M167V, P58A, F194W, M167S, R61L, R61P, R61N, I94F, R61I, F165I, R61V, F165A, F165V, F165S, M167G, M167A, D38A+M167A, P250I+M167A, E247A+M167A, P250M+M167A, D91N+M167A, R219S+M167A, D37N+M167A, K34A+M167A, E164P+M167A, R219A+M167A, R61L+M167A, F165A+M167A, D91S+M167A, D37T+M167A, R219T+M167A, K166S+M167A, Q170E+M167A, D37S+M167A, K166T+M167A, D63N+M167A, F165S+M167A, D91T+M167A, K291A+M167A, Q246A+M167A, E247Q+M167A, D37A+M167A, Q246T+M167A, D38E+M167A, D38N+M167A, E247D+M167A, E171Q+M167A, K291T+M167A, D243A+M167A, D290N+M167A, D290Q+M167A, Q246S+M167A, R219K+M167A, D63R+M167A, D290A+M167A, D63E+M167A, R193N+M167A, E245D+M167A, D290E+M167A, E164A+M167A, D243Q+M167A, D243G+M167A, D243N+M167A, E245Q+M167A, Q170D+M167A, E171A+M167A, Q170N+M167A, P250A+M167A, P250G+M167A, R193Q+M167A, N312D+M167A, R61V+M167A+P250G, W266F+M167A+P250G, R61L+N312D+M167A, I94F+M167A+P250G, N312D+M167A+P250G, R61N+M167A+P250G, R193Q+M167A+P250G, E171Q+M167A+P250G, F165V+M167A+P250G, R61P+M167A+P250G, Q246S+M167A+P250G, E245D+M167A+P250G, K291T+M167A+P250G, R61L+M167A+P250G, R61I+M167A+P250G, E245D+M167A+P250G+R61L, F169V+M167A+P250G+R61L, F165S+M167A+P250G+R61L, G59P+M167A+P250G+R61L, N312D+M167A+P250G+R61L, G59A+M167A+P250G+R61L, I94V+M167A+P250G+R61L, F165M+M167A+P250G+R61L, I94A+M167A+P250G+R61L, C96G+M167A+P250G+R61L, F169I+M167A+P250G+R61L, P58M+M167A+P250G+R61L, T216A+M167A+P250G+R61L, K291T+M167A+P250G+R61L, G59S+M167A+P250G+R61L, S293T+M167A+P250G+R61L, F169L+M167A+P250G+R61L, P58V+M167A+P250G+R61L, P58A+M167A+P250G+R61L, or C96A+M167A+P250G+R61L of the mature polypeptide of SEQ ID NO: 2.

11. A composition comprising the variant of claim 1.

12. The composition of claim 11, wherein the composition is a micro emulsion or a lotion.

13. A method for decontaminating an area or a device contaminated with at least one harmful or undesired organophosphorous compound, comprising contacting the area or device with the variant of claim 1.

14. The method of claim 13, wherein the at least one harmful or undesired organophosphorous compound is selected from the group consisting of G-agents, V-agents and pesticides.

15. A method for removing an organophosphorous compound, comprising contacting the organophosphorous compound with the variant of claim 1.

16. A polynucleotide encoding the variant of claim 1.

17. A nucleic acid construct or expression vector comprising the polynucleotide of claim 16.

18. A host cell comprising the polynucleotide of claim 16.

19. A method of producing an organophosphorous hydrolase variant, comprising:
   (a) cultivating the host cell of claim 18 under conditions suitable for expression of the variant; and
   (b) recovering the variant.

20. The variant of claim 1, wherein the variant has at least 95% sequence identity to the mature polypeptide of SEQ ID NO: 2.

* * * * *